United States Patent 12,185,725 (BCA CONTROL OF STB) - sequence listing, part 31

SEQ ID NO: 1 - DNA, 63241173 bp, Clonostachys rosea (residues 61,201,141-63,241,173 of 63,241,173)
  misc_feature (1004022)..(1004022): n is a, c, g, or t
  misc_feature (1004884)..(1004886): n is a, c, g, or t
  misc_feature (1007091)..(1007093): n is a, c, g, or t
  misc_feature (1273510)..(1273515): n is a, c, g, or t
  misc_feature (1491479)..(1491516): n is a, c, g, or t
  misc_feature (1622006)..(1622008): n is a, c, g, or t
  misc_feature (1622486)..(1622526): n is a, c, g, or t
  misc_feature (1945921)..(1945923): n is a, c, g, or t
  misc_feature (2186631)..(2186631): n is a, c, g, or t
  misc_feature (2363519)..(2363519): n is a, c, g, or t
  misc_feature (3003988)..(3004034): n is a, c, g, or t
  misc_feature (3006951)..(3006951): n is a, c, g, or t
  misc_feature (3039734)..(3039736): n is a, c, g, or t
  misc_feature (3046114)..(3046168): n is a, c, g, or t
  misc_feature (3047352)..(3047352): n is a, c, g, or t
  misc_feature (3460813)..(3460816): n is a, c, g, or t
  misc_feature (3639064)..(3639064): n is a, c, g, or t
  misc_feature (3746222)..(3746222): n is a, c, g, or t
  misc_feature (4241995)..(4242004): n is a, c, g, or t
  misc_feature (4475448)..(4475448): n is a, c, g, or t
  misc_feature (4510206)..(4510206): n is a, c, g, or t
  misc_feature (4560264)..(4560274): n is a, c, g, or t
  misc_feature (4664816)..(4664831): n is a, c, g, or t
  misc_feature (4665147)..(4665225): n is a, c, g, or t
  misc_feature (4689063)..(4689097): n is a, c, g, or t
  misc_feature (4799467)..(4799467): n is a, c, g, or t
  misc_feature (5267192)..(5267251): n is a, c, g, or t
  misc_feature (5268549)..(5268551): n is a, c, g, or t
  misc_feature (5633359)..(5633359): n is a, c, g, or t
  misc_feature (5655891)..(5655906): n is a, c, g, or t
  misc_feature (5766024)..(5766046): n is a, c, g, or t
  misc_feature (5929755)..(5929755): n is a, c, g, or t
  misc_feature (6255892)..(6255898): n is a, c, g, or t
  misc_feature (6511898)..(6511903): n is a, c, g, or t
  misc_feature (6716454)..(6716471): n is a, c, g, or t
  misc_feature (7713256)..(7713332): n is a, c, g, or t
  misc_feature (7813886)..(7813898): n is a, c, g, or t
  misc_feature (8154636)..(8154652): n is a, c, g, or t
  misc_feature (8385915)..(8385915): n is a, c, g, or t
  misc_feature (8643645)..(8643659): n is a, c, g, or t
  misc_feature (8818690)..(8818690): n is a, c, g, or t
  misc_feature (8823963)..(8823969): n is a, c, g, or t
  misc_feature (8871470)..(8871513): n is a, c, g, or t
  misc_feature (8931084)..(8931169): n is a, c, g, or t
  misc_feature (9235562)..(9235572): n is a, c, g, or t
  misc_feature (9481541)..(9481541): n is a, c, g, or t
  misc_feature (9963013)..(9963026): n is a, c, g, or t
  misc_feature (10103656)..(10103667): n is a, c, g, or t
  misc_feature (10255692)..(10255692): n is a, c, g, or t
  misc_feature (10262298)..(10262305): n is a, c, g, or t
  misc_feature (10301030)..(10301032): n is a, c, g, or t
  misc_feature (10451609)..(10451614): n is a, c, g, or t
  misc_feature (10731373)..(10731373): n is a, c, g, or t
  misc_feature (11696241)..(11696273): n is a, c, g, or t
  misc_feature (11739018)..(11739018): n is a, c, g, or t
  misc_feature (11965869)..(11966018): n is a, c, g, or t
  misc_feature (11976640)..(11976679): n is a, c, g, or t
  misc_feature (12069619)..(12069643): n is a, c, g, or t
  misc_feature (12107239)..(12107253): n is a, c, g, or t
  misc_feature (12161236)..(12161255): n is a, c, g, or t
  misc_feature (12179157)..(12179160): n is a, c, g, or t
  misc_feature (12556274)..(12556274): n is a, c, g, or t
  misc_feature (12770113)..(12770124): n is a, c, g, or t
  misc_feature (12998503)..(12998542): n is a, c, g, or t
  misc_feature (13065570)..(13065570): n is a, c, g, or t
  misc_feature (13066700)..(13066724): n is a, c, g, or t
  misc_feature (13093959)..(13093979): n is a, c, g, or t
  misc_feature (13125970)..(13125983): n is a, c, g, or t
  misc_feature (13148715)..(13148723): n is a, c, g, or t
  misc_feature (13293327)..(13293329): n is a, c, g, or t
  misc_feature (14016619)..(14016619): n is a, c, g, or t
  misc_feature (14407542)..(14407544): n is a, c, g, or t
  misc_feature (14411025)..(14411025): n is a, c, g, or t
  misc_feature (14704475)..(14704482): n is a, c, g, or t
  misc_feature (15155196)..(15155196): n is a, c, g, or t
  misc_feature (15190628)..(15190628): n is a, c, g, or t
  misc_feature (15287798)..(15287841): n is a, c, g, or t
  misc_feature (15650558)..(15650558): n is a, c, g, or t
  misc_feature (15662298)..(15662309): n is a, c, g, or t
  misc_feature (16619049)..(16619049): n is a, c, g, or t
  misc_feature (16631697)..(16631734): n is a, c, g, or t
  misc_feature (16945683)..(16945683): n is a, c, g, or t
  misc_feature (17533823)..(17533829): n is a, c, g, or t
  misc_feature (17703140)..(17703140): n is a, c, g, or t
  misc_feature (17882033)..(17882033): n is a, c, g, or t
  misc_feature (18448568)..(18448625): n is a, c, g, or t
  misc_feature (18847351)..(18847351): n is a, c, g, or t
  misc_feature (18866422)..(18866422): n is a, c, g, or t
  misc_feature (19275043)..(19275067): n is a, c, g, or t
  misc_feature (19692510)..(19692520): n is a, c, g, or t
  misc_feature (19781619)..(19781678): n is a, c, g, or t
  misc_feature (20675280)..(20675280): n is a, c, g, or t
  misc_feature (20695841)..(20695843): n is a, c, g, or t
  misc_feature (21178495)..(21178514): n is a, c, g, or t
  misc_feature (21189000)..(21189041): n is a, c, g, or t
  misc_feature (21233048)..(21233158): n is a, c, g, or t
  misc_feature (21269516)..(21269608): n is a, c, g, or t
  misc_feature (21367232)..(21367238): n is a, c, g, or t
  misc_feature (21390578)..(21390580): n is a, c, g, or t
  misc_feature (21488338)..(21488338): n is a, c, g, or t
  misc_feature (22029283)..(22029290): n is a, c, g, or t
  misc_feature (22202447)..(22202449): n is a, c, g, or t
  misc_feature (23967734)..(23967738): n is a, c, g, or t
  misc_feature (24077668)..(24077668): n is a, c, g, or t
  misc_feature (24108910)..(24108921): n is a, c, g, or t
  misc_feature (24560700)..(24560724): n is a, c, g, or t
  misc_feature (24571255)..(24571272): n is a, c, g, or t
  misc_feature (25962142)..(25962161): n is a, c, g, or t
  misc_feature (26014865)..(26014909): n is a, c, g, or t
  misc_feature (26163349)..(26163351): n is a, c, g, or t
  misc_feature (26228782)..(26228782): n is a, c, g, or t
  misc_feature (26859120)..(26859120): n is a, c, g, or t
  misc_feature (27465019)..(27465042): n is a, c, g, or t
  misc_feature (27843838)..(27843858): n is a, c, g, or t
  misc_feature (27859213)..(27859213): n is a, c, g, or t
  misc_feature (27860086)..(27860086): n is a, c, g, or t
  misc_feature (29166646)..(29166646): n is a, c, g, or t
  misc_feature (29203147)..(29203147): n is a, c, g, or t
  misc_feature (29377653)..(29377653): n is a, c, g, or t
  misc_feature (29389167)..(29389167): n is a, c, g, or t
  misc_feature (29389532)..(29389532): n is a, c, g, or t
  misc_feature (29954172)..(29954176): n is a, c, g, or t
  misc_feature (30475823)..(30475836): n is a, c, g, or t
  misc_feature (31100878)..(31100878): n is a, c, g, or t
  misc_feature (31112152)..(31112180): n is a, c, g, or t
  misc_feature (31177709)..(31177859): n is a, c, g, or t
  misc_feature (31204353)..(31204376): n is a, c, g, or t
  misc_feature (31218238)..(31218269): n is a, c, g, or t
  misc_feature (31263223)..(31263243): n is a, c, g, or t
  misc_feature (31266759)..(31266759): n is a, c, g, or t
  misc_feature (31598712)..(31598712): n is a, c, g, or t
  misc_feature (31720769)..(31720846): n is a, c, g, or t
  misc_feature (31734313)..(31734466): n is a, c, g, or t
  misc_feature (31887307)..(31887307): n is a, c, g, or t
  misc_feature (31997037)..(31997037): n is a, c, g, or t
  misc_feature (32222116)..(32222118): n is a, c, g, or t
  misc_feature (32354795)..(32354795): n is a, c, g, or t
  misc_feature (32513372)..(32513372): n is a, c, g, or t
  misc_feature (32516439)..(32516453): n is a, c, g, or t
  misc_feature (33790664)..(33790691): n is a, c, g, or t
  misc_feature (33920149)..(33920190): n is a, c, g, or t
  misc_feature (34021515)..(34021564): n is a, c, g, or t
  misc_feature (34027227)..(34027276): n is a, c, g, or t
  misc_feature (34033950)..(34033950): n is a, c, g, or t
  misc_feature (34034596)..(34034645): n is a, c, g, or t
  misc_feature (34036294)..(34036294): n is a, c, g, or t
  misc_feature (34036837)..(34036886): n is a, c, g, or t
  misc_feature (34062605)..(34062654): n is a, c, g, or t
  misc_feature (34062890)..(34062939): n is a, c, g, or t
  misc_feature (34063442)..(34063502): n is a, c, g, or t
  misc_feature (34064299)..(34064348): n is a, c, g, or t
  misc_feature (34064685)..(34064685): n is a, c, g, or t
  misc_feature (34064944)..(34064993): n is a, c, g, or t
  misc_feature (34065663)..(34065822): n is a, c, g, or t
  misc_feature (34067235)..(34067284): n is a, c, g, or t
  misc_feature (34231907)..(34231907): n is a, c, g, or t
  misc_feature (34232109)..(34232158): n is a, c, g, or t
  misc_feature (34232405)..(34232405): n is a, c, g, or t
  misc_feature (34232639)..(34232688): n is a, c, g, or t
  misc_feature (34234134)..(34234183): n is a, c, g, or t
  misc_feature (34234416)..(34234465): n is a, c, g, or t
  misc_feature (34234718)..(34234740): n is a, c, g, or t
  misc_feature (34235808)..(34235808): n is a, c, g, or t
  misc_feature (34236013)..(34236117): n is a, c, g, or t
  misc_feature (34236683)..(34236732): n is a, c, g, or t
  misc_feature (34236978)..(34237027): n is a, c, g, or t
  misc_feature (34237259)..(34237259): n is a, c, g, or t
  misc_feature (34237527)..(34237576): n is a, c, g, or t
  misc_feature (34243863)..(34243912): n is a, c, g, or t
  misc_feature (34244121)..(34244186): n is a, c, g, or t
  misc_feature (34263184)..(34263349): n is a, c, g, or t
  misc_feature (34264167)..(34264208): n is a, c, g, or t
  misc_feature (34265193)..(34265242): n is a, c, g, or t
  misc_feature (34266178)..(34266227): n is a, c, g, or t
  misc_feature (34270752)..(34270801): n is a, c, g, or t
  misc_feature (34271040)..(34271089): n is a, c, g, or t
  misc_feature (34275451)..(34275500): n is a, c, g, or t
  misc_feature (34280267)..(34280316): n is a, c, g, or t
  misc_feature (34290277)..(34290277): n is a, c, g, or t
  misc_feature (34297336)..(34297336): n is a, c, g, or t
  misc_feature (34297596)..(34297645): n is a, c, g, or t
  misc_feature (34299425)..(34299585): n is a, c, g, or t
  misc_feature (34301363)..(34301441): n is a, c, g, or t
  misc_feature (34305766)..(34305815): n is a, c, g, or t
  misc_feature (34306081)..(34306130): n is a, c, g, or t
  misc_feature (34306365)..(34306414): n is a, c, g, or t
  misc_feature (34310328)..(34310328): n is a, c, g, or t
  misc_feature (34310554)..(34310603): n is a, c, g, or t
  misc_feature (34314743)..(34314792): n is a, c, g, or t
  misc_feature (34460208)..(34460257): n is a, c, g, or t
  misc_feature (34478331)..(34478331): n is a, c, g, or t
  misc_feature (34478534)..(34478590): n is a, c, g, or t
  misc_feature (34480765)..(34480765): n is a, c, g, or t
  misc_feature (34481043)..(34481092): n is a, c, g, or t
  misc_feature (34481522)..(34481571): n is a, c, g, or t
  misc_feature (34485079)..(34485128): n is a, c, g, or t
  misc_feature (34486762)..(34486811): n is a, c, g, or t
  misc_feature (34495182)..(34495182): n is a, c, g, or t
  misc_feature (34495386)..(34495435): n is a, c, g, or t
  misc_feature (34495865)..(34495914): n is a, c, g, or t
  misc_feature (34497067)..(34497084): n is a, c, g, or t
  misc_feature (34748425)..(34748474): n is a, c, g, or t
  misc_feature (34748800)..(34748848): n is a, c, g, or t
  misc_feature (35159653)..(35159653): n is a, c, g, or t
  misc_feature (35162792)..(35162971): n is a, c, g, or t
  misc_feature (35164108)..(35164159): n is a, c, g, or t
  misc_feature (35164681)..(35164730): n is a, c, g, or t
  misc_feature (35167996)..(35168105): n is a, c, g, or t
  misc_feature (35169110)..(35169159): n is a, c, g, or t
  misc_feature (35170362)..(35170362): n is a, c, g, or t
  misc_feature (35170687)..(35170736): n is a, c, g, or t
  misc_feature (35176251)..(35176355): n is a, c, g, or t
  misc_feature (35176926)..(35176975): n is a, c, g, or t
  misc_feature (35177403)..(35177403): n is a, c, g, or t
  misc_feature (35177607)..(35177656): n is a, c, g, or t
  misc_feature (35184373)..(35184422): n is a, c, g, or t
  misc_feature (35184904)..(35184904): n is a, c, g, or t
  misc_feature (35185279)..(35185328): n is a, c, g, or t
  misc_feature (35210065)..(35210065): n is a, c, g, or t
  misc_feature (35240548)..(35240548): n is a, c, g, or t
  misc_feature (35364083)..(35364106): n is a, c, g, or t
  misc_feature (35929649)..(35929800): n is a, c, g, or t
  misc_feature (35932668)..(35932717): n is a, c, g, or t
  misc_feature (35935994)..(35936043): n is a, c, g, or t
  misc_feature (36067652)..(36067652): n is a, c, g, or t
  misc_feature (36067874)..(36067923): n is a, c, g, or t
  misc_feature (36069205)..(36069205): n is a, c, g, or t
  misc_feature (36069464)..(36069513): n is a, c, g, or t
  misc_feature (36070405)..(36070454): n is a, c, g, or t
  misc_feature (36072042)..(36072091): n is a, c, g, or t
  misc_feature (36081279)..(36081328): n is a, c, g, or t
  misc_feature (36082250)..(36082360): n is a, c, g, or t
  misc_feature (36082923)..(36082972): n is a, c, g, or t
  misc_feature (36083419)..(36083435): n is a, c, g, or t
  misc_feature (36083853)..(36083853): n is a, c, g, or t
  misc_feature (36084074)..(36084123): n is a, c, g, or t
  misc_feature (36092718)..(36092718): n is a, c, g, or t
  misc_feature (36092982)..(36093059): n is a, c, g, or t
  misc_feature (36096616)..(36096640): n is a, c, g, or t
  misc_feature (36096738)..(36096738): n is a, c, g, or t
  misc_feature (36096992)..(36097041): n is a, c, g, or t
  misc_feature (36098465)..(36098465): n is a, c, g, or t
  misc_feature (36098757)..(36098806): n is a, c, g, or t
  misc_feature (36100772)..(36100772): n is a, c, g, or t
  misc_feature (36101051)..(36101100): n is a, c, g, or t
  misc_feature (36101306)..(36101306): n is a, c, g, or t
  misc_feature (36101564)..(36101613): n is a, c, g, or t
  misc_feature (36101835)..(36101835): n is a, c, g, or t
  misc_feature (36102079)..(36102157): n is a, c, g, or t
  misc_feature (36682299)..(36682348): n is a, c, g, or t
  misc_feature (36682604)..(36682653): n is a, c, g, or t
  misc_feature (36689683)..(36689732): n is a, c, g, or t
  misc_feature (36692431)..(36692480): n is a, c, g, or t
  misc_feature (36697373)..(36697373): n is a, c, g, or t
  misc_feature (36697677)..(36697726): n is a, c, g, or t
  misc_feature (36699812)..(36699812): n is a, c, g, or t
  misc_feature (36700209)..(36700258): n is a, c, g, or t
  misc_feature (36863034)..(36863065): n is a, c, g, or t
  misc_feature (37154011)..(37154024): n is a, c, g, or t
  misc_feature (37300828)..(37300877): n is a, c, g, or t
  misc_feature (37301501)..(37301550): n is a, c, g, or t
  misc_feature (37301772)..(37301772): n is a, c, g, or t
  misc_feature (37302087)..(37302136): n is a, c, g, or t
  misc_feature (37313512)..(37313512): n is a, c, g, or t
  misc_feature (37313733)..(37313782): n is a, c, g, or t
  misc_feature (37334743)..(37334743): n is a, c, g, or t
  misc_feature (37335086)..(37335135): n is a, c, g, or t
  misc_feature (37339864)..(37339864): n is a, c, g, or t
  misc_feature (37340073)..(37340122): n is a, c, g, or t
  misc_feature (37340671)..(37340720): n is a, c, g, or t
  misc_feature (37340961)..(37341064): n is a, c, g, or t
  misc_feature (37341375)..(37341424): n is a, c, g, or t
  misc_feature (37342687)..(37342687): n is a, c, g, or t
  misc_feature (37343949)..(37343998): n is a, c, g, or t
  misc_feature (37344604)..(37344604): n is a, c, g, or t
  misc_feature (37348936)..(37349009): n is a, c, g, or t
  misc_feature (37353682)..(37353802): n is a, c, g, or t
  misc_feature (37354047)..(37354096): n is a, c, g, or t
  misc_feature (37404163)..(37404212): n is a, c, g, or t
  misc_feature (37404462)..(37404511): n is a, c, g, or t
  misc_feature (37409635)..(37409635): n is a, c, g, or t
  misc_feature (37409882)..(37409931): n is a, c, g, or t
  misc_feature (37410497)..(37410546): n is a, c, g, or t
  misc_feature (37410844)..(37410893): n is a, c, g, or t
  misc_feature (37412342)..(37412342): n is a, c, g, or t
  misc_feature (37412565)..(37412614): n is a, c, g, or t
  misc_feature (37412850)..(37412850): n is a, c, g, or t
  misc_feature (37413087)..(37413136): n is a, c, g, or t
  misc_feature (37418649)..(37418649): n is a, c, g, or t
  misc_feature (37419828)..(37419877): n is a, c, g, or t
  misc_feature (37472476)..(37472480): n is a, c, g, or t
  misc_feature (37539526)..(37539539): n is a, c, g, or t
  misc_feature (37887342)..(37887342): n is a, c, g, or t
  misc_feature (38498636)..(38498638): n is a, c, g, or t
  misc_feature (38499508)..(38499557): n is a, c, g, or t
  misc_feature (38499825)..(38499874): n is a, c, g, or t
  misc_feature (38500624)..(38500673): n is a, c, g, or t
  misc_feature (38500972)..(38500972): n is a, c, g, or t
  misc_feature (38501225)..(38501274): n is a, c, g, or t
  misc_feature (38501623)..(38501623): n is a, c, g, or t
  misc_feature (38501824)..(38501873): n is a, c, g, or t
  misc_feature (38502434)..(38502434): n is a, c, g, or t
  misc_feature (38502681)..(38502734): n is a, c, g, or t
  misc_feature (38529582)..(38529582): n is a, c, g, or t
  misc_feature (38529810)..(38529886): n is a, c, g, or t
  misc_feature (38562440)..(38562440): n is a, c, g, or t
  misc_feature (38562928)..(38562977): n is a, c, g, or t
  misc_feature (38566706)..(38566755): n is a, c, g, or t
  misc_feature (38567188)..(38567237): n is a, c, g, or t
  misc_feature (38567475)..(38567524): n is a, c, g, or t
  misc_feature (38568632)..(38568632): n is a, c, g, or t
  misc_feature (38568863)..(38568912): n is a, c, g, or t
  misc_feature (38574067)..(38574116): n is a, c, g, or t
  misc_feature (38576744)..(38576859): n is a, c, g, or t
  misc_feature (38582306)..(38582491): n is a, c, g, or t
  misc_feature (38838603)..(38838603): n is a, c, g, or t
  misc_feature (38838848)..(38839043): n is a, c, g, or t
  misc_feature (38840383)..(38840383): n is a, c, g, or t
  misc_feature (38840584)..(38840633): n is a, c, g, or t
  misc_feature (38840900)..(38840900): n is a, c, g, or t
  misc_feature (38841140)..(38841189): n is a, c, g, or t
  misc_feature (38841863)..(38841863): n is a, c, g, or t
  misc_feature (38842075)..(38842124): n is a, c, g, or t
  misc_feature (38842348)..(38842348): n is a, c, g, or t
  misc_feature (38842582)..(38842631): n is a, c, g, or t
  misc_feature (38845694)..(38845743): n is a, c, g, or t
  misc_feature (38856447)..(38856496): n is a, c, g, or t
  misc_feature (38872256)..(38872256): n is a, c, g, or t
  misc_feature (38872705)..(38872754): n is a, c, g, or t
  misc_feature (38953405)..(38953409): n is a, c, g, or t
  misc_feature (38985368)..(38985368): n is a, c, g, or t
  misc_feature (38985682)..(38985731): n is a, c, g, or t
  misc_feature (38988632)..(38988632): n is a, c, g, or t
  misc_feature (38989078)..(38989127): n is a, c, g, or t
  misc_feature (39124540)..(39124582): n is a, c, g, or t
  misc_feature (39462568)..(39462617): n is a, c, g, or t
  misc_feature (39467549)..(39467549): n is a, c, g, or t
  misc_feature (39467753)..(39467802): n is a, c, g, or t
  misc_feature (39512225)..(39512227): n is a, c, g, or t
  misc_feature (39512322)..(39512322): n is a, c, g, or t
  misc_feature (39513122)..(39513171): n is a, c, g, or t
  misc_feature (39518598)..(39518598): n is a, c, g, or t
  misc_feature (39518803)..(39518852): n is a, c, g, or t
  misc_feature (39519308)..(39519357): n is a, c, g, or t
  misc_feature (39520199)..(39520248): n is a, c, g, or t
  misc_feature (39522531)..(39522531): n is a, c, g, or t
  misc_feature (39522764)..(39522764): n is a, c, g, or t
  misc_feature (39523101)..(39523150): n is a, c, g, or t
  misc_feature (39524022)..(39524022): n is a, c, g, or t
  misc_feature (39524237)..(39524286): n is a, c, g, or t
  misc_feature (39528072)..(39528072): n is a, c, g, or t
  misc_feature (39529672)..(39529721): n is a, c, g, or t
  misc_feature (39531579)..(39531579): n is a, c, g, or t
  misc_feature (39531784)..(39531833): n is a, c, g, or t
  misc_feature (39535545)..(39535545): n is a, c, g, or t
  misc_feature (39536852)..(39536901): n is a, c, g, or t
  misc_feature (39547133)..(39547133): n is a, c, g, or t
  misc_feature (39547421)..(39547470): n is a, c, g, or t
  misc_feature (39549142)..(39549232): n is a, c, g, or t
  misc_feature (39549654)..(39549716): n is a, c, g, or t
  misc_feature (39561911)..(39561922): n is a, c, g, or t
  misc_feature (39714619)..(39714668): n is a, c, g, or t
  misc_feature (39717606)..(39717606): n is a, c, g, or t
  misc_feature (39717874)..(39717928): n is a, c, g, or t
  misc_feature (39737340)..(39737422): n is a, c, g, or t
  misc_feature (39738084)..(39738133): n is a, c, g, or t
  misc_feature (39739478)..(39739527): n is a, c, g, or t
  misc_feature (39755184)..(39755233): n is a, c, g, or t
  misc_feature (39755474)..(39755556): n is a, c, g, or t
  misc_feature (39756808)..(39756808): n is a, c, g, or t
  misc_feature (39757076)..(39757152): n is a, c, g, or t
  misc_feature (39759363)..(39759412): n is a, c, g, or t
  misc_feature (39760067)..(39760116): n is a, c, g, or t
  misc_feature (39763175)..(39763175): n is a, c, g, or t
  misc_feature (39763381)..(39764484): n is a, c, g, or t
  misc_feature (39769986)..(39770157): n is a, c, g, or t
  misc_feature (39770931)..(39770991): n is a, c, g, or t
  misc_feature (39771820)..(39771946): n is a, c, g, or t
  misc_feature (39772149)..(39772149): n is a, c, g, or t
  misc_feature (39773226)..(39773226): n is a, c, g, or t
  misc_feature (39773460)..(39773509): n is a, c, g, or t
  misc_feature (39774303)..(39774303): n is a, c, g, or t
  misc_feature (39774536)..(39774585): n is a, c, g, or t
  misc_feature (39775573)..(39775573): n is a, c, g, or t
  misc_feature (39775880)..(39775929): n is a, c, g, or t
  misc_feature (39776580)..(39776629): n is a, c, g, or t
  misc_feature (39842017)..(39842114): n is a, c, g, or t
  misc_feature (39920733)..(39920733): n is a, c, g, or t
  misc_feature (39940147)..(39940196): n is a, c, g, or t
  misc_feature (39956615)..(39956615): n is a, c, g, or t
  misc_feature (39970725)..(39970774): n is a, c, g, or t
  misc_feature (39989394)..(39989394): n is a, c, g, or t
  misc_feature (40284366)..(40284415): n is a, c, g, or t
  misc_feature (40285876)..(40285876): n is a, c, g, or t
  misc_feature (40614874)..(40614923): n is a, c, g, or t
  misc_feature (40641594)..(40641594): n is a, c, g, or t
  misc_feature (40641923)..(40641923): n is a, c, g, or t
  misc_feature (40689276)..(40689348): n is a, c, g, or t
  misc_feature (40705218)..(40705267): n is a, c, g, or t
  misc_feature (40780980)..(40781029): n is a, c, g, or t
  misc_feature (40878859)..(40878859): n is a, c, g, or t
  misc_feature (40907436)..(40907436): n is a, c, g, or t
  misc_feature (40939935)..(40939984): n is a, c, g, or t
  misc_feature (41047689)..(41047689): n is a, c, g, or t
  misc_feature (41085017)..(41085066): n is a, c, g, or t
  misc_feature (41097600)..(41097600): n is a, c, g, or t
  misc_feature (41193529)..(41193532): n is a, c, g, or t
  misc_feature (41210596)..(41210597): n is a, c, g, or t
  misc_feature (41454254)..(41454254): n is a, c, g, or t
  misc_feature (41455190)..(41455239): n is a, c, g, or t
  misc_feature (41464964)..(41464964): n is a, c, g, or t
  misc_feature (41470137)..(41470186): n is a, c, g, or t
  misc_feature (41474829)..(41474878): n is a, c, g, or t
  misc_feature (41475130)..(41475179): n is a, c, g, or t
  misc_feature (41475389)..(41475464): n is a, c, g, or t
  misc_feature (41476193)..(41476193): n is a, c, g, or t
  misc_feature (41478132)..(41478181): n is a, c, g, or t
  misc_feature (41479843)..(41479892): n is a, c, g, or t
  misc_feature (41555467)..(41555467): n is a, c, g, or t
  misc_feature (41556805)..(41556854): n is a, c, g, or t
  misc_feature (41558771)..(41558771): n is a, c, g, or t
  misc_feature (41559758)..(41559807): n is a, c, g, or t
  misc_feature (41560011)..(41560046): n is a, c, g, or t
  misc_feature (41578146)..(41578146): n is a, c, g, or t
  misc_feature (41589023)..(41589072): n is a, c, g, or t
  misc_feature (41609568)..(41609617): n is a, c, g, or t
  misc_feature (41618331)..(41618398): n is a, c, g, or t
  misc_feature (41625746)..(41625882): n is a, c, g, or t
  misc_feature (41626482)..(41626576): n is a, c, g, or t
  misc_feature (41659037)..(41659037): n is a, c, g, or t
  misc_feature (41669189)..(41669238): n is a, c, g, or t
  misc_feature (41686082)..(41686214): n is a, c, g, or t
  misc_feature (41688125)..(41688174): n is a, c, g, or t
  misc_feature (41688576)..(41688625): n is a, c, g, or t
  misc_feature (41690214)..(41690263): n is a, c, g, or t
  misc_feature (41712579)..(41712579): n is a, c, g, or t
  misc_feature (42130267)..(42130267): n is a, c, g, or t
  misc_feature (42130585)..(42130634): n is a, c, g, or t
  misc_feature (42134256)..(42134325): n is a, c, g, or t
  misc_feature (42275262)..(42275262): n is a, c, g, or t
  misc_feature (42665266)..(42665282): n is a, c, g, or t
  misc_feature (42692785)..(42692807): n is a, c, g, or t
  misc_feature (42715068)..(42715083): n is a, c, g, or t
  misc_feature (42724057)..(42724074): n is a, c, g, or t
  misc_feature (42783171)..(42783171): n is a, c, g, or t
  misc_feature (42789276)..(42789375): n is a, c, g, or t
  misc_feature (42816840)..(42816929): n is a, c, g, or t
  misc_feature (42817270)..(42817319): n is a, c, g, or t
  misc_feature (42824981)..(42825030): n is a, c, g, or t
  misc_feature (42825231)..(42825280): n is a, c, g, or t
  misc_feature (42857192)..(42857241): n is a, c, g, or t
  misc_feature (42861151)..(42861200): n is a, c, g, or t
  misc_feature (42862104)..(42862155): n is a, c, g, or t
  misc_feature (42889151)..(42889200): n is a, c, g, or t
  misc_feature (42894035)..(42894035): n is a, c, g, or t
  misc_feature (42895733)..(42895804): n is a, c, g, or t
  misc_feature (42912361)..(42912410): n is a, c, g, or t
  misc_feature (42913543)..(42913592): n is a, c, g, or t
  misc_feature (42913841)..(42913890): n is a, c, g, or t
  misc_feature (42914530)..(42914579): n is a, c, g, or t
  misc_feature (42915142)..(42915191): n is a, c, g, or t
  misc_feature (42917068)..(42917068): n is a, c, g, or t
  misc_feature (42917638)..(42917687): n is a, c, g, or t
  misc_feature (42917999)..(42917999): n is a, c, g, or t
  misc_feature (42918415)..(42918464): n is a, c, g, or t
  misc_feature (42922303)..(42922303): n is a, c, g, or t
  misc_feature (43020711)..(43020736): n is a, c, g, or t
  misc_feature (43138158)..(43138199): n is a, c, g, or t
  misc_feature (43285903)..(43285910): n is a, c, g, or t
  misc_feature (43918474)..(43918484): n is a, c, g, or t
  misc_feature (44111898)..(44111947): n is a, c, g, or t
  misc_feature (44224860)..(44224869): n is a, c, g, or t
  misc_feature (44367954)..(44367954): n is a, c, g, or t
  misc_feature (44509331)..(44509353): n is a, c, g, or t
  misc_feature (44812599)..(44812599): n is a, c, g, or t
  misc_feature (44814011)..(44814060): n is a, c, g, or t
  misc_feature (44816890)..(44816890): n is a, c, g, or t
  misc_feature (44817515)..(44817618): n is a, c, g, or t
  misc_feature (44819113)..(44819113): n is a, c, g, or t
  misc_feature (44821645)..(44821695): n is a, c, g, or t
  misc_feature (44835619)..(44835619): n is a, c, g, or t
  misc_feature (44852140)..(44852203): n is a, c, g, or t
  misc_feature (44858104)..(44858153): n is a, c, g, or t
  misc_feature (44858355)..(44858455): n is a, c, g, or t
  misc_feature (44859891)..(44859891): n is a, c, g, or t
  misc_feature (44861274)..(44861323): n is a, c, g, or t
  misc_feature (44939342)..(44939342): n is a, c, g, or t
  misc_feature (45145777)..(45145799): n is a, c, g, or t
  misc_feature (45178245)..(45178245): n is a, c, g, or t
  misc_feature (45179749)..(45180150): n is a, c, g, or t
  misc_feature (45183682)..(45183732): n is a, c, g, or t
  misc_feature (45191153)..(45191202): n is a, c, g, or t
  misc_feature (45193248)..(45193248): n is a, c, g, or t
  misc_feature (45194579)..(45194679): n is a, c, g, or t
  misc_feature (45199094)..(45199094): n is a, c, g, or t
  misc_feature (45199791)..(45199840): n is a, c, g, or t
  misc_feature (45200382)..(45200382): n is a, c, g, or t
  misc_feature (45381079)..(45381167): n is a, c, g, or t
  misc_feature (45508079)..(45508128): n is a, c, g, or t
  misc_feature (45508880)..(45508929): n is a, c, g, or t
  misc_feature (45511685)..(45511734): n is a, c, g, or t
  misc_feature (45521589)..(45521638): n is a, c, g, or t
  misc_feature (45522735)..(45522784): n is a, c, g, or t
  misc_feature (45522999)..(45523048): n is a, c, g, or t
  misc_feature (45556881)..(45556930): n is a, c, g, or t
  misc_feature (45637359)..(45637408): n is a, c, g, or t
  misc_feature (45683703)..(45683703): n is a, c, g, or t
  misc_feature (45697862)..(45697911): n is a, c, g, or t
  misc_feature (45725301)..(45725350): n is a, c, g, or t
  misc_feature (45726284)..(45726333): n is a, c, g, or t
  misc_feature (45726622)..(45726671): n is a, c, g, or t
  misc_feature (45735683)..(45735683): n is a, c, g, or t
  misc_feature (45737800)..(45737849): n is a, c, g, or t
  misc_feature (45743546)..(45743546): n is a, c, g, or t
  misc_feature (45745825)..(45745874): n is a, c, g, or t
  misc_feature (45746091)..(45746091): n is a, c, g, or t
  misc_feature (45753724)..(45753773): n is a, c, g, or t
  misc_feature (45756973)..(45756973): n is a, c, g, or t
  misc_feature (45758505)..(45758554): n is a, c, g, or t
  misc_feature (45788143)..(45788143): n is a, c, g, or t
  misc_feature (45802503)..(45802503): n is a, c, g, or t
  misc_feature (46083991)..(46084096): n is a, c, g, or t
  misc_feature (46102916)..(46102965): n is a, c, g, or t
  misc_feature (46103167)..(46103216): n is a, c, g, or t
  misc_feature (46109258)..(46109307): n is a, c, g, or t
  misc_feature (46152221)..(46152235): n is a, c, g, or t
  misc_feature (46362499)..(46362499): n is a, c, g, or t
  misc_feature (46363494)..(46363543): n is a, c, g, or t
  misc_feature (46368231)..(46368280): n is a, c, g, or t
  misc_feature (46381356)..(46381405): n is a, c, g, or t
  misc_feature (46397811)..(46397860): n is a, c, g, or t
  misc_feature (46449717)..(46449769): n is a, c, g, or t
  misc_feature (46460075)..(46460159): n is a, c, g, or t
  misc_feature (46460553)..(46460602): n is a, c, g, or t
  misc_feature (46464367)..(46464416): n is a, c, g, or t
  misc_feature (46467864)..(46467913): n is a, c, g, or t
  misc_feature (46470073)..(46470166): n is a, c, g, or t
  misc_feature (46472256)..(46472256): n is a, c, g, or t
  misc_feature (46476636)..(46476742): n is a, c, g, or t
  misc_feature (46483600)..(46483649): n is a, c, g, or t
  misc_feature (46483891)..(46483940): n is a, c, g, or t
  misc_feature (46489942)..(46489991): n is a, c, g, or t
  misc_feature (46493579)..(46493628): n is a, c, g, or t
  misc_feature (46496964)..(46496964): n is a, c, g, or t
  misc_feature (46497326)..(46497375): n is a, c, g, or t
  misc_feature (46499939)..(46499988): n is a, c, g, or t
  misc_feature (46500296)..(46500368): n is a, c, g, or t
  misc_feature (46514171)..(46514171): n is a, c, g, or t
  misc_feature (46515328)..(46515377): n is a, c, g, or t
  misc_feature (46515593)..(46515593): n is a, c, g, or t
  misc_feature (46519671)..(46519720): n is a, c, g, or t
  misc_feature (46521429)..(46521429): n is a, c, g, or t
  misc_feature (46534680)..(46534820): n is a, c, g, or t
  misc_feature (46537987)..(46537987): n is a, c, g, or t
  misc_feature (46558003)..(46558052): n is a, c, g, or t
  misc_feature (46779598)..(46779647): n is a, c, g, or t
  misc_feature (46790276)..(46790325): n is a, c, g, or t
  misc_feature (46791525)..(46791525): n is a, c, g, or t
  misc_feature (46800289)..(46800338): n is a, c, g, or t
  misc_feature (46805256)..(46805256): n is a, c, g, or t
  misc_feature (46812509)..(46812558): n is a, c, g, or t
  misc_feature (46816694)..(46816694): n is a, c, g, or t
  misc_feature (46817194)..(46817243): n is a, c, g, or t
  misc_feature (46940655)..(46940655): n is a, c, g, or t
  misc_feature (46941331)..(46941380): n is a, c, g, or t
  misc_feature (46944598)..(46944598): n is a, c, g, or t
  misc_feature (46948116)..(46948165): n is a, c, g, or t
  misc_feature (46952525)..(46952574): n is a, c, g, or t
  misc_feature (46952744)..(46952813): n is a, c, g, or t
  misc_feature (46953095)..(46953144): n is a, c, g, or t
  misc_feature (46953738)..(46953787): n is a, c, g, or t
  misc_feature (46954092)..(46954141): n is a, c, g, or t
  misc_feature (46954391)..(46954440): n is a, c, g, or t
  misc_feature (46954673)..(46954722): n is a, c, g, or t
  misc_feature (46957857)..(46957906): n is a, c, g, or t
  misc_feature (46958923)..(46958972): n is a, c, g, or t
  misc_feature (46959775)..(46959824): n is a, c, g, or t
  misc_feature (47336074)..(47336074): n is a, c, g, or t
  misc_feature (47769204)..(47769253): n is a, c, g, or t
  misc_feature (47949992)..(47950010): n is a, c, g, or t
  misc_feature (48075208)..(48075216): n is a, c, g, or t
  misc_feature (48279155)..(48279204): n is a, c, g, or t
  misc_feature (48281879)..(48281879): n is a, c, g, or t
  misc_feature (48283636)..(48283685): n is a, c, g, or t
  misc_feature (48295442)..(48295491): n is a, c, g, or t
  misc_feature (48298142)..(48298191): n is a, c, g, or t
  misc_feature (48298912)..(48298961): n is a, c, g, or t
  misc_feature (48306832)..(48306832): n is a, c, g, or t
  misc_feature (48308251)..(48308293): n is a, c, g, or t
  misc_feature (48308497)..(48308546): n is a, c, g, or t
  misc_feature (48310544)..(48310544): n is a, c, g, or t
  misc_feature (48310960)..(48310960): n is a, c, g, or t
  misc_feature (48614152)..(48614201): n is a, c, g, or t
  misc_feature (49019941)..(49019941): n is a, c, g, or t
  misc_feature (49034046)..(49034095): n is a, c, g, or t
  misc_feature (49035397)..(49035397): n is a, c, g, or t
  misc_feature (49038653)..(49038702): n is a, c, g, or t
  misc_feature (49048594)..(49048643): n is a, c, g, or t
  misc_feature (49048864)..(49048918): n is a, c, g, or t
  misc_feature (49064229)..(49064278): n is a, c, g, or t
  misc_feature (49064758)..(49064879): n is a, c, g, or t
  misc_feature (49075016)..(49075069): n is a, c, g, or t
  misc_feature (49080643)..(49080717): n is a, c, g, or t
  misc_feature (49080946)..(49080995): n is a, c, g, or t
  misc_feature (49081288)..(49081337): n is a, c, g, or t
  misc_feature (49082727)..(49082727): n is a, c, g, or t
  misc_feature (49083960)..(49084010): n is a, c, g, or t
  misc_feature (49094466)..(49094515): n is a, c, g, or t
  misc_feature (49097699)..(49097748): n is a, c, g, or t
  misc_feature (49098088)..(49098137): n is a, c, g, or t
  misc_feature (49103831)..(49103831): n is a, c, g, or t
  misc_feature (49104387)..(49104436): n is a, c, g, or t
  misc_feature (49212384)..(49212384): n is a, c, g, or t
  misc_feature (49215580)..(49215629): n is a, c, g, or t
  misc_feature (49247521)..(49247521): n is a, c, g, or t
  misc_feature (49263219)..(49263268): n is a, c, g, or t
  misc_feature (49555926)..(49556044): n is a, c, g, or t
  misc_feature (49630888)..(49630937): n is a, c, g, or t
  misc_feature (49631231)..(49631305): n is a, c, g, or t
  misc_feature (49661552)..(49661552): n is a, c, g, or t
  misc_feature (50385665)..(50385665): n is a, c, g, or t
  misc_feature (50690479)..(50690479): n is a, c, g, or t
  misc_feature (50690679)..(50690679): n is a, c, g, or t
  misc_feature (50701364)..(50701413): n is a, c, g, or t
  misc_feature (50702110)..(50702110): n is a, c, g, or t
  misc_feature (50707317)..(50707483): n is a, c, g, or t
  misc_feature (50723022)..(50723022): n is a, c, g, or t
  misc_feature (50725035)..(50725084): n is a, c, g, or t
  misc_feature (50741922)..(50741971): n is a, c, g, or t
  misc_feature (50742893)..(50742942): n is a, c, g, or t
  misc_feature (50743433)..(50743433): n is a, c, g, or t
  misc_feature (50748403)..(50748452): n is a, c, g, or t
  misc_feature (50764816)..(50764902): n is a, c, g, or t
  misc_feature (50765114)..(50765163): n is a, c, g, or t
  misc_feature (50845954)..(50845954): n is a, c, g, or t
  misc_feature (50889359)..(50889387): n is a, c, g, or t
  misc_feature (50893037)..(50893086): n is a, c, g, or t
  misc_feature (50893412)..(50893412): n is a, c, g, or t
  misc_feature (50900776)..(50900825): n is a, c, g, or t
  misc_feature (50907347)..(50907347): n is a, c, g, or t
  misc_feature (50912683)..(50912732): n is a, c, g, or t
  misc_feature (51038242)..(51038339): n is a, c, g, or t
  misc_feature (51236302)..(51236351): n is a, c, g, or t
  misc_feature (51237052)..(51237052): n is a, c, g, or t
  misc_feature (51238377)..(51238426): n is a, c, g, or t
  misc_feature (51239089)..(51239089): n is a, c, g, or t
  misc_feature (51241769)..(51241818): n is a, c, g, or t
  misc_feature (51243484)..(51243484): n is a, c, g, or t
  misc_feature (51309569)..(51309618): n is a, c, g, or t
  misc_feature (51331944)..(51331944): n is a, c, g, or t
  misc_feature (51485449)..(51485498): n is a, c, g, or t
  misc_feature (51602850)..(51602851): n is a, c, g, or t
  misc_feature (52004728)..(52004728): n is a, c, g, or t
  misc_feature (52015515)..(52015515): n is a, c, g, or t
  misc_feature (52019477)..(52019526): n is a, c, g, or t
  misc_feature (52019845)..(52019845): n is a, c, g, or t
  misc_feature (52021812)..(52021942): n is a, c, g, or t
  misc_feature (52022704)..(52022704): n is a, c, g, or t
  misc_feature (52026565)..(52026614): n is a, c, g, or t
  misc_feature (52048644)..(52048693): n is a, c, g, or t
  misc_feature (52048878)..(52049012): n is a, c, g, or t
  misc_feature (52049402)..(52049466): n is a, c, g, or t
  misc_feature (52178151)..(52178227): n is a, c, g, or t
  misc_feature (52187685)..(52187688): n is a, c, g, or t
  misc_feature (52190057)..(52190061): n is a, c, g, or t
  misc_feature (52285607)..(52285656): n is a, c, g, or t
  misc_feature (52285993)..(52286042): n is a, c, g, or t
  misc_feature (52289007)..(52289077): n is a, c, g, or t
  misc_feature (52290263)..(52290312): n is a, c, g, or t
  misc_feature (52293110)..(52293136): n is a, c, g, or t
  misc_feature (52293381)..(52293430): n is a, c, g, or t
  misc_feature (52300941)..(52300990): n is a, c, g, or t
  misc_feature (52428849)..(52428853): n is a, c, g, or t
  misc_feature (52442428)..(52442477): n is a, c, g, or t
  misc_feature (52654493)..(52654542): n is a, c, g, or t
  misc_feature (52654847)..(52654896): n is a, c, g, or t
  misc_feature (52655611)..(52655660): n is a, c, g, or t
  misc_feature (52793697)..(52793717): n is a, c, g, or t
  misc_feature (52796751)..(52796800): n is a, c, g, or t
  misc_feature (52802476)..(52802525): n is a, c, g, or t
  misc_feature (53018531)..(53018531): n is a, c, g, or t
  misc_feature (53021249)..(53021298): n is a, c, g, or t
  misc_feature (53057063)..(53057112): n is a, c, g, or t
  misc_feature (53173878)..(53173903): n is a, c, g, or t
  misc_feature (53612422)..(53612471): n is a, c, g, or t
  misc_feature (53695822)..(53695838): n is a, c, g, or t
  misc_feature (54259020)..(54259064): n is a, c, g, or t
  misc_feature (54288602)..(54288602): n is a, c, g, or t
  misc_feature (54289777)..(54289826): n is a, c, g, or t
  misc_feature (54290242)..(54290291): n is a, c, g, or t
  misc_feature (54302128)..(54302128): n is a, c, g, or t
  misc_feature (54304521)..(54304570): n is a, c, g, or t
  misc_feature (54308597)..(54308646): n is a, c, g, or t
  misc_feature (54309268)..(54309342): n is a, c, g, or t
  misc_feature (54309855)..(54309904): n is a, c, g, or t
  misc_feature (54310108)..(54310157): n is a, c, g, or t
  misc_feature (54310576)..(54310576): n is a, c, g, or t
  misc_feature (54324787)..(54324836): n is a, c, g, or t
  misc_feature (54325598)..(54325598): n is a, c, g, or t
  misc_feature (54326212)..(54326261): n is a, c, g, or t
  misc_feature (54326485)..(54326485): n is a, c, g, or t
  misc_feature (54327006)..(54327006): n is a, c, g, or t
  misc_feature (55175746)..(55175752): n is a, c, g, or t
  misc_feature (55336349)..(55336370): n is a, c, g, or t
  misc_feature (55343389)..(55343390): n is a, c, g, or t
  misc_feature (55412216)..(55412216): n is a, c, g, or t
  misc_feature (55430238)..(55430238): n is a, c, g, or t
  misc_feature (55438748)..(55438849): n is a, c, g, or t
  misc_feature (55461152)..(55461152): n is a, c, g, or t
  misc_feature (55461834)..(55461883): n is a, c, g, or t
  misc_feature (55665121)..(55665176): n is a, c, g, or t
  misc_feature (55665929)..(55665978): n is a, c, g, or t
  misc_feature (55695277)..(55695277): n is a, c, g, or t
  misc_feature (55871267)..(55871305): n is a, c, g, or t
  misc_feature (55958135)..(55958151): n is a, c, g, or t
  misc_feature (55958385)..(55958385): n is a, c, g, or t
  misc_feature (56042796)..(56042845): n is a, c, g, or t
  misc_feature (56066211)..(56066314): n is a, c, g, or t
  misc_feature (56157319)..(56157326): n is a, c, g, or t
  misc_feature (56359196)..(56359196): n is a, c, g, or t
  misc_feature (56807737)..(56807764): n is a, c, g, or t
  misc_feature (56992773)..(56992773): n is a, c, g, or t
  misc_feature (56993104)..(56993104): n is a, c, g, or t
  misc_feature (56994993)..(56995042): n is a, c, g, or t
  misc_feature (57056425)..(57056425): n is a, c, g, or t
  misc_feature (57058109)..(57058158): n is a, c, g, or t
  misc_feature (57090109)..(57090158): n is a, c, g, or t
  misc_feature (57091922)..(57091971): n is a, c, g, or t
  misc_feature (57108771)..(57108771): n is a, c, g, or t
  misc_feature (57111261)..(57111351): n is a, c, g, or t
  misc_feature (57116253)..(57116302): n is a, c, g, or t
  misc_feature (57119071)..(57119120): n is a, c, g, or t
  misc_feature (57119329)..(57119378): n is a, c, g, or t
  misc_feature (57121759)..(57121759): n is a, c, g, or t
  misc_feature (57186012)..(57186012): n is a, c, g, or t
  misc_feature (57198037)..(57198037): n is a, c, g, or t
  misc_feature (57282139)..(57282139): n is a, c, g, or t
  misc_feature (57364932)..(57364981): n is a, c, g, or t
  misc_feature (57555332)..(57555332): n is a, c, g, or t
  misc_feature (57650790)..(57650790): n is a, c, g, or t
  misc_feature (57652001)..(57652066): n is a, c, g, or t
  misc_feature (57659281)..(57659281): n is a, c, g, or t
  misc_feature (57660824)..(57660873): n is a, c, g, or t
  misc_feature (57662100)..(57662100): n is a, c, g, or t
  misc_feature (57675042)..(57675091): n is a, c, g, or t
  misc_feature (57862977)..(57862977): n is a, c, g, or t
  misc_feature (57863942)..(57863991): n is a, c, g, or t
  misc_feature (57869572)..(57869572): n is a, c, g, or t
  misc_feature (57872680)..(57872729): n is a, c, g, or t
  misc_feature (58113365)..(58113365): n is a, c, g, or t
  misc_feature (58189326)..(58189326): n is a, c, g, or t
  misc_feature (58213371)..(58213376): n is a, c, g, or t
  misc_feature (58436030)..(58436030): n is a, c, g, or t
  misc_feature (58436462)..(58436511): n is a, c, g, or t
  misc_feature (58446592)..(58446641): n is a, c, g, or t
  misc_feature (58446898)..(58446978): n is a, c, g, or t
  misc_feature (58451975)..(58452656): n is a, c, g, or t
  misc_feature (58454547)..(58454596): n is a, c, g, or t
  misc_feature (58455705)..(58455754): n is a, c, g, or t
  misc_feature (58456018)..(58456067): n is a, c, g, or t
  misc_feature (58456326)..(58456375): n is a, c, g, or t
  misc_feature (58456581)..(58456630): n is a, c, g, or t
  misc_feature (58457888)..(58457888): n is a, c, g, or t
  misc_feature (58458794)..(58458843): n is a, c, g, or t
  misc_feature (58509181)..(58509230): n is a, c, g, or t
  misc_feature (58511946)..(58511946): n is a, c, g, or t
  misc_feature (58512772)..(58512821): n is a, c, g, or t
  misc_feature (58515129)..(58516137): n is a, c, g, or t
  misc_feature (58517923)..(58517972): n is a, c, g, or t
  misc_feature (58520075)..(58520189): n is a, c, g, or t
  misc_feature (58521792)..(58521792): n is a, c, g, or t
  misc_feature (58523889)..(58523938): n is a, c, g, or t
  misc_feature (58536820)..(58536886): n is a, c, g, or t
  misc_feature (58542153)..(58542202): n is a, c, g, or t
  misc_feature (58545256)..(58545403): n is a, c, g, or t
  misc_feature (58557304)..(58557353): n is a, c, g, or t
  misc_feature (58579539)..(58579539): n is a, c, g, or t
  misc_feature (58582947)..(58582996): n is a, c, g, or t
  misc_feature (58585228)..(58585228): n is a, c, g, or t
  misc_feature (58586780)..(58586838): n is a, c, g, or t
  misc_feature (58595308)..(58595308): n is a, c, g, or t
  misc_feature (58596100)..(58596149): n is a, c, g, or t
  misc_feature (58600231)..(58600319): n is a, c, g, or t
  misc_feature (58605994)..(58606043): n is a, c, g, or t
  misc_feature (58606247)..(58606296): n is a, c, g, or t
  misc_feature (58620693)..(58620793): n is a, c, g, or t
  misc_feature (58651779)..(58651779): n is a, c, g, or t
  misc_feature (58653547)..(58653596): n is a, c, g, or t
  misc_feature (58697577)..(58697626): n is a, c, g, or t
  misc_feature (58921196)..(58921217): n is a, c, g, or t
  misc_feature (59391831)..(59391831): n is a, c, g, or t
  misc_feature (59392654)..(59392810): n is a, c, g, or t
  misc_feature (59394063)..(59394063): n is a, c, g, or t
  misc_feature (59394164)..(59394166): n is a, c, g, or t
  misc_feature (59394742)..(59394762): n is a, c, g, or t
  misc_feature (59464971)..(59465020): n is a, c, g, or t
  misc_feature (59465115)..(59465265): n is a, c, g, or t
  misc_feature (59466634)..(59466634): n is a, c, g, or t
  misc_feature (59713212)..(59713261): n is a, c, g, or t
  misc_feature (59814087)..(59814087): n is a, c, g, or t
  misc_feature (59814738)..(59814824): n is a, c, g, or t
  misc_feature (59902994)..(59902994): n is a, c, g, or t
  misc_feature (59906866)..(59906915): n is a, c, g, or t
  misc_feature (59917061)..(59917061): n is a, c, g, or t
  misc_feature (59923987)..(59924036): n is a, c, g, or t
  misc_feature (59928165)..(59928214): n is a, c, g, or t
  misc_feature (59929039)..(59929088): n is a, c, g, or t
  misc_feature (60135434)..(60135483): n is a, c, g, or t
  misc_feature (60386895)..(60386944): n is a, c, g, or t
  misc_feature (60399184)..(60399265): n is a, c, g, or t
  misc_feature (60427016)..(60427109): n is a, c, g, or t
  misc_feature (60430645)..(60430645): n is a, c, g, or t
  misc_feature (60432277)..(60432326): n is a, c, g, or t
  misc_feature (60444636)..(60444685): n is a, c, g, or t
  misc_feature (60444907)..(60444956): n is a, c, g, or t
  misc_feature (60447185)..(60447185): n is a, c, g, or t
  misc_feature (60448685)..(60448734): n is a, c, g, or t
  misc_feature (60461699)..(60461699): n is a, c, g, or t
  misc_feature (60462549)..(60462598): n is a, c, g, or t
  misc_feature (60473448)..(60473497): n is a, c, g, or t
  misc_feature (60478924)..(60478973): n is a, c, g, or t
  misc_feature (60481758)..(60481807): n is a, c, g, or t
  misc_feature (60486917)..(60486917): n is a, c, g, or t
  misc_feature (60658670)..(60658713): n is a, c, g, or t
  misc_feature (61191181)..(61191230): n is a, c, g, or t
  misc_feature (61226428)..(61226477): n is a, c, g, or t
  misc_feature (61227157)..(61227206): n is a, c, g, or t
  misc_feature (61228028)..(61228173): n is a, c, g, or t
  misc_feature (61229861)..(61229861): n is a, c, g, or t
  misc_feature (61439426)..(61439486): n is a, c, g, or t
  misc_feature (61738577)..(61738577): n is a, c, g, or t
  misc_feature (61753473)..(61753475): n is a, c, g, or t
  misc_feature (61754599)..(61754648): n is a, c, g, or t
  misc_feature (61755021)..(61755021): n is a, c, g, or t
  misc_feature (61755746)..(61755795): n is a, c, g, or t
  misc_feature (61756774)..(61756844): n is a, c, g, or t
  misc_feature (61767200)..(61767315): n is a, c, g, or t
  misc_feature (61767533)..(61767673): n is a, c, g, or t
  misc_feature (62044093)..(62044142): n is a, c, g, or t
  misc_feature (62244010)..(62244015): n is a, c, g, or t
  misc_feature (62246831)..(62246880): n is a, c, g, or t
  misc_feature (62255413)..(62255462): n is a, c, g, or t
  misc_feature (62264304)..(62264304): n is a, c, g, or t
  misc_feature (62325388)..(62325437): n is a, c, g, or t
  misc_feature (62557043)..(62557043): n is a, c, g, or t
  misc_feature (62557779)..(62557828): n is a, c, g, or t
  misc_feature (62558631)..(62558650): n is a, c, g, or t
  misc_feature (62559274)..(62559395): n is a, c, g, or t
  misc_feature (62560653)..(62560751): n is a, c, g, or t
  misc_feature (62569070)..(62569070): n is a, c, g, or t
  misc_feature (62570387)..(62570389): n is a, c, g, or t
  misc_feature (62574780)..(62574829): n is a, c, g, or t
  misc_feature (62586898)..(62586947): n is a, c, g, or t
  misc_feature (62589043)..(62589131): n is a, c, g, or t
  misc_feature (62589638)..(62589687): n is a, c, g, or t
  misc_feature (62590271)..(62590337): n is a, c, g, or t
  misc_feature (62592974)..(62593085): n is a, c, g, or t
  misc_feature (62593535)..(62593535): n is a, c, g, or t
  misc_feature (62595430)..(62595430): n is a, c, g, or t
  misc_feature (62602255)..(62602373): n is a, c, g, or t
  misc_feature (62632077)..(62632126): n is a, c, g, or t
  misc_feature (62632639)..(62632639): n is a, c, g, or t
  misc_feature (62649674)..(62649674): n is a, c, g, or t
  misc_feature (62652902)..(62653006): n is a, c, g, or t
  misc_feature (62661587)..(62661636): n is a, c, g, or t
  misc_feature (62665533)..(62665582): n is a, c, g, or t
  misc_feature (62665934)..(62665934): n is a, c, g, or t
  misc_feature (62666484)..(62666533): n is a, c, g, or t
  misc_feature (62667073)..(62667073): n is a, c, g, or t
  misc_feature (62669020)..(62669069): n is a, c, g, or t
  misc_feature (62673469)..(62673493): n is a, c, g, or t
  misc_feature (62673949)..(62674048): n is a, c, g, or t
  misc_feature (62696077)..(62696077): n is a, c, g, or t
  misc_feature (62696632)..(62696703): n is a, c, g, or t
  misc_feature (62707797)..(62707797): n is a, c, g, or t
  misc_feature (62708403)..(62708452): n is a, c, g, or t
  misc_feature (62719096)..(62719145): n is a, c, g, or t
  misc_feature (62720176)..(62720225): n is a, c, g, or t
  misc_feature (62720426)..(62720426): n is a, c, g, or t
  misc_feature (62737768)..(62737768): n is a, c, g, or t
  misc_feature (62739873)..(62739922): n is a, c, g, or t
  misc_feature (62746534)..(62746583): n is a, c, g, or t
  misc_feature (62747156)..(62747205): n is a, c, g, or t
  misc_feature (62749136)..(62749269): n is a, c, g, or t
  misc_feature (62750296)..(62750345): n is a, c, g, or t
  misc_feature (62755059)..(62755059): n is a, c, g, or t
  misc_feature (62760563)..(62760612): n is a, c, g, or t
  misc_feature (62763197)..(62763197): n is a, c, g, or t
  misc_feature (62763427)..(62763476): n is a, c, g, or t
  misc_feature (62768449)..(62768449): n is a, c, g, or t
  misc_feature (62769213)..(62769271): n is a, c, g, or t
  misc_feature (62796402)..(62796402): n is a, c, g, or t
  misc_feature (62798293)..(62799030): n is a, c, g, or t
  misc_feature (62802879)..(62802879): n is a, c, g, or t
  misc_feature (62808918)..(62808967): n is a, c, g, or t
  misc_feature (62812625)..(62812625): n is a, c, g, or t
  misc_feature (62813183)..(62813232): n is a, c, g, or t
  misc_feature (62843242)..(62843349): n is a, c, g, or t
  misc_feature (62843585)..(62843634): n is a, c, g, or t
  misc_feature (62858536)..(62858646): n is a, c, g, or t
  misc_feature (62859116)..(62859208): n is a, c, g, or t
  misc_feature (62864786)..(62864786): n is a, c, g, or t
  misc_feature (62870461)..(62870510): n is a, c, g, or t
  misc_feature (62878333)..(62878382): n is a, c, g, or t
  misc_feature (62912961)..(62912961): n is a, c, g, or t
  misc_feature (63123687)..(63123736): n is a, c, g, or t
  misc_feature (63132040)..(63132042): n is a, c, g, or t
  misc_feature (63138997)..(63139046): n is a, c, g, or t
  misc_feature (63141728)..(63141728): n is a, c, g, or t
  misc_feature (63155642)..(63155691): n is a, c, g, or t
  misc_feature (63156204)..(63156204): n is a, c, g, or t
  misc_feature (63158857)..(63159032): n is a, c, g, or t
  misc_feature (63160081)..(63160195): n is a, c, g, or t
  misc_feature (63163164)..(63163164): n is a, c, g, or t
  misc_feature (63164792)..(63164841): n is a, c, g, or t
  misc_feature (63167130)..(63167130): n is a, c, g, or t
  misc_feature (63168593)..(63168642): n is a, c, g, or t
  misc_feature (63189372)..(63189372): n is a, c, g, or t
  misc_feature (63201843)..(63201892): n is a, c, g, or t
  misc_feature (63221239)..(63221239): n is a, c, g, or t
  misc_feature (63223532)..(63223634): n is a, c, g, or t
  misc_feature (63227341)..(63227341): n is a, c, g, or t
  misc_feature (63230218)..(63230267): n is a, c, g, or t
  misc_feature (63231327)..(63231327): n is a, c, g, or t
  misc_feature (63233685)..(63233734): n is a, c, g, or t
  misc_feature (63238574)..(63238574): n is a, c, g, or t
  misc_feature (63240329)..(63240378): n is a, c, g, or t
tggcgcaggagtgcaagcgcatcttggaaggtattcccggctgtgtagtttggctgactttgagagcctacgactccagtgatggaagagaagagaagaaaaaagtctaagtcctggggtaactgctggtgcaagttccaagaccctgcgactttcggaagcactgcttccctccactgctgcgccgacattctgtcgaagccaatgtcctatcgtatacaatgagcaaaagccgagaagtagagtagctgatgtgaattcgagacttactcttatcaccattgacgattgaatgcagcctttgataggaggcatattatccttacaccaagtcaaaacttccccaagggcgaatgggtcagaaacgtcacaaggaggtgtatatacatcaaccccctgcgcgagaaggcgttgaacaaacccggcagatgacttactcttggcacctcgtctagacagcagaataaaatggcgagcgcctttcttgaccatccacttgacgacactctggccaagtccacccaagccacccgcgataatataggtgccatgagtgtcgaaactccaggacgtttcgggtcttagtgtggccttgatgggactcgtcagcgcaaaggccaagcactctagggttgggggtatgctttttaccgttactagcatctggggttccgtttccaccactgccttgcccgcgttgattccgctctggaggtagcggagagactcttctacctgccctaccgagaaggcctttaatgggaagacgcttttaagcctgccactctgaaataagtcaagtatctttgacaacatacttgatagcatcctagggcgctccttgcccatgcttgcgatgtcgactgccgcaaacgtgacatttcgcgcgaatgggtgcatgggaagcacgcgccgggacaagatatcctttttaccgatttcgatgaagcgtccatatggcgctatgcagtcccatgatgctgataggccagagcctgcgaggctatttaagactacattaacaccctgcccatcggtgagtctcatgattcccttagcaaaagacaagtccctgctgtacaagatgttttctgcagggacgtcgtagagatccattataagctgcttcttatgattggagcccacggtgacatggaccttagcaccgcagagctgggcgacttgaatagccgcttgcccggtgccgccggccccgccgtgaatcaagacactctcgccttcagccaattgggcgacctcgatgagggcgcgatacgccgtcatgaagttgatcgggatagcggcggcttcggtaaaaggcatggactcgggtataggaatggccatgaaggccttacaacggacggcccggcggaaggggtttgaatgaaaagccacaaccttgtcaccgggtttgaggtgaccctcggagcctacctttgagatgatgccagagcactcacaccccaggttgttgtcggggactctgcctaacgcgacgagtagatcacggaaattgacacccacggccctgacttcaatttcaacctcatctgctgctagtggggtggatgatttgtcaagaacctcttcaaagtgcagagattcgagcagtccgggtgaccggatctttaactcaaggtccctcgacccaaatggtacatcctgctcaatactggaaactgaagtgtggattgtttgattgcgtgcatcatcttcgtagacccgggggatttctaagaatcccgagttttggacaagttcgggttcgtaaaccccggttcggattccatctatagtgttttcgaatacctgcctgacaaagagagtgacctgctcatccttgctactgaggctggctattgtgaaaatgaaccctggacgctcaaggcgaagggtccttgcaagccccgtaatcatggcctcttgaggacactgtgctggttccgggatctcgttgagccagaggactgccttcgctttgacaagagtggactggagcgcatagtattcttggtcgccgagtctatcgagcattggccaagacctgccgtcgcatatgacaataaggagctgcgcttgtaatgcttcatcgcgggatgcatcgtcaaacgtgccaactttgcatgttggacatctggagacctcctgtactatctggcagaagggtaagcttggtttatgggcctgatcaaaccccgttacaatcctgacatgaatgccagtctctgcagtagcgcgggatatttcttcggtagcagtggacaaaatgcagctgaccatattggccccctcacgctcgtggtcgtgtgcgacaaagtccaacccagagaatccatgttgcttcaaaacgtggtcccattgtgtctctgcgagaagtggcccattgggtctgtacgcatcagtgcctgttcgcctctattagcgtgtaatgtcaacctgctctcttgtgagtctatttgtacttagccaccacccaggaagacagccgaatacaatcggcatttgtattttctcgggttccgttatttcaatgagtattaacttgccgtccctgatggctgttagttgccacaacactaattttctcttcctgttttaactcttagagggtgttccaactgacctttttagtagggagcgaactgctctaagcgtcacgtccaaggattttgtggcgtggaggacctagatagtattagttggctgtgttaagctaatttagagaagcccaagagcctcacatttgctgccacaaccacatcaaacgaatgtggttcgtaaccttgttcgccggctatattttcaacattgaagaggctaaaattcatattaggatatgcgccgaaattctctttggccatactgagaaaggctggagaaatgtcagtgaactcgtagtgggaatactgtgcggtatatccatacgacgtcttcgtcgtaagcatgtccagtatgcgctgcgttgttgagccggtcccggcaccaacctcgatcaccttgagggatggcgacttgtgagcaaggagcttcatgaaaacgctcaagggaccgaagaagctgcttgagtcggtgttgtaatcatagtatgtccggaggttgttgtcttgattcaaaaactcaagagcgtcgactctaccctgaagaatgtcttgcagacaatctagaaactccagatagagctgtccaatcttgccgcgactttcaactcgtttgcggatattctccaaagtgtcaagcggactctttatgctaattgatatttgtttgatccattttagctgccttcgtaggtgagggagatgggaaggaatgctgtcctcttggacctcctgagatatcctctttgccgagaccgccactagttgctcaatgtctgtccaagttagggcagcttccacatcttgttggccctgaccttgtaagagattgcgaagacgggcagtatcgatcagggagatgtcaggcttgaatgtcattttgtaacagagctgtcgggcatgagtttgggctgaatcagaaccatccgtagttgtgattgacgttgcctcaagaccattcatttgaaccttgagcaatccatttgtattattaaaagcagagcaatcaagctgatgcgtccggcgatttgtcaagcgccgcagtgtatgggcttgcagctggatgcttgaatctggcaacaggccatctctcgcaatccaaagtcggtcaattctagttggaatcatggtgggcgttttgacgtttcctccagcggttatagcgggtaacatgacctggatcacgccatcaagtgaagctgggtgaataactgctggtagggctccagaaggatcctcaaataacgaaacatcaccgacgcattctcccactccctcccaatatgcgtgcgtaatgcgacggaagctgccggtaaagtgatagccaaacttgtgtagacgagagtaaagcgtatggcccttgacgtttttagtcgaatcttgaagagcccgggaagcattctttatagcaatatcttgggctgcttcgagttcttggatatgatcgaggtgggctggagcagtttctgcaaatatgggttcaatggtgcctcgacaaattattgtaatggcattgccgtgatgagactggatgtgaaactcgaagcctgaatctagccgatttgggctgtgagctagatcaaccagtcgagtagtcacttcgaccccttcttcatcttctggcacggcaagagcagcaagaaattcaactcctctgcattcaaaggctgtcaacttctggtcaaaatgcttcgtgacttggacaacagcttccatggccattacaagcatgcctgcggccgggaatagaacgtcaccattgatcttttatgcatttaagcatagtcagtcttgcgttattaaccttgagtaaatgcgagtgaagatgctgcttaccttgtgatcgcggatccaggccgttggtgaggacgcggccgcgcttaggaaatggcgccaactaggctctgagttgttccagtcggctactggtgatcccaaaaaaggattgaatccatgatctcgaagacgaatctgcttactgatgcggccttccctccagtacgatgtggagtggtcgaagggataagctggaagggaagggaggaccgagcgatgatgcttaagtgactgtttgagagaattcacgcggtcgatgttgagcggaaagccgacacagtgcaacctccctgccgcctccatcagggtaaggatagccgaccttttcctgatgagacaggagctgtagcggacattccgagagacagaaacgttgctcaagatctctcgaattgggcctgcgagtgtggaatgagggccgatctcgagtagatcggtaacgctcacttcccgtcggtgactcagatcgatctttttggtctctgaagacatagagttctggcagcatgcttcaactgcttggcagaacttgacctgcaaagtcaagttcctcacccagtattcagggtcagtaagcacatccaaaggcacgatatggccggtcactgatgatatcatagggacttctttgtggccccggaaaccggcctctagttttccgatgctattggtatatctggcggcaatcattttcatttgcggtgaatgatatgccacgggaactgcaagtactcgattaaacacttcatcttgatccaagcgagtcttgaggagattgatgagaagtcgacttcccgatactgttacgttcttgggactgttaatacaagcgacacatagcaaccctccagggcattgtgccagtatttcttcaaggtacgtattcgccttctcgagggatgtgccaacagagatcatgccggcctctatcgtccttgattggccgagctcactcgaaaaaagtccacggagatacgccagtcgccatgcggcttcggatgaaatcccgcctacagcataggctgcagcaatttctccgctggagtgccctataacaactgaaggcaggaggttgaacgatttgagaaggtccactaacgcaacctgaaggactgtgcatgcaggctgggccagcgcaggagcgttcaagttcattgaaccttcaaatgtggtgaagcaatctgtaaatcaataactcagtatgccatgtacttagtcaattgttggagtaaactcttacttatcaagctccaggagcatcccaatctttgcagataggactctgccctcttgatgctgcggcagaagacgtcgtacatcaggagttcttttcccatgccaagccattgggccccctgaccggtgaatacgaatccaactctcggacgattttgagccttggtgggagctgggatttcggaaatagcttttgataaagaaggaagagaatctgcaactgcgtatgacctccatgggtatatgctccttcgttcactaagagtgaaagcaagagactcgagattaccatagtcggcgctctctgattgtagtaagtctgttaggtgggcttcatacgaattcaaaactcttttcactgcagccgaatctggagctgaccaaacaagaagttgtgggattggaggcaaaagggggtcctggacgcccaaccccaacccgttggcgacagggtgctgaagactacgaaactcctccacactgcggtcggctgagaccccgttggtacagtgaagagtctttctttgctccagtcttacctgcgggtcaaccatggtgcaatggattccttttaggccatgctcttgcagaaaatggtgagcatcatccaggactgcatgtgcattggttcctccaaagccggaggagcacacggaagcccgacgaaggccagacccgggccaagggcgacacactgtaggaaactgaaatagtcgttaatttctaatgcttgttgttcctcctagtagcaatgagttttcctcacctccagattgagaaactcggcgtcgatggcagggttcaacctttgcaaattggcaatgggtggaattatacccttttccagaatcatgactgctcggactattcctgccaggccgctggtcccttcagtatggccaatgctggcctttgctgtgccactgcagcaagttcttaatcaatgccatgatttttttggttgcagaataaggcagatcgacttacacataaaccggatcatccctgccatgataatgtccaaaagcttcgccaatagcgccagcctcgatagggtctcccttggaagtccctgttccatgggcctccacgtatcgagtacgggacaaacttaaccccgccgaggcataagtatcttcaatcaaatgcacttgggcctctttgctaggttgtgccaagctggtggtgccgttctggttagttccggtagctctcacgacggcccttatcagatctccatcccgaatcgcggcggatacaggcttgattattagtgcggcgaagccctcgccacgactgtagccatttgcacgctcgtcaaagctgtaacatactccatcaggagagagaaaacccatccgagataggcctatagtggtatcaagggcgtagacaaggttacaccctgcgacaatgccctgtttcctagttagctgcctgcatatgcatcctctttaggcgattggattcatgcggtatactcaccatggaagtctctcccctccaaagggacttacaagcttggtcaaacgcgaccaggctgcttgaacaagcggtgtcaatggtcatgctaggccccttgaggttgaaaaagttgctcaatctgttggagagatacgtcccagccaggcctgtggacgtgtaattgggaattaactccggatcttttgagctaatcatggtatagtccatagtgaaattgccagtgtatacagcagtattggtgccactgatctttgcgatgggtataccggctattgagttgtcagaggctgttgggtctcgaagtaatagctgcgaggagaacataccgttttcgagtgccttgtaggtggtttcaaggaggccgcgttgctgcggatccatggcatccgcctcggcggcagtaatggagaagaagggggcgtcgaacaaggatacatcagtctccaagaaatgagccttcttcggccgaatctatcactcaacggttagagggaaaccgcggtaacggaccatcaaatggtaaaacactaaccgtcccttgtactgaccccttcccttcgcaccatgcttcgtggtttactctatctggtggaaactcacgagcagcacaccggcctgccacagttaagtcccagaatgcctctaccgagctcgcttcaggaagattaactgagaacccaatgatggcaatggcttcgtcagcgttcttttcctggggcgtaagctgggtgctcgaattgtccgagtcattatacacaaatggagacattttgaatacactgaagtcgaaaatgagcaaagggcatatgcgatcatctgtattatctcagtctctccttgtatgaaactaaatacaacaagttctgcgggtcgggctactaatcctagtcctaatggcccgcttacttcctttggctatcacgttatcttgatatacggaagtatttgacttccttccataggcttttaccccttagtgtcatccgataaagtctcgaaagaacctttgttcatgttctggcgaaaatggctctatactctgcatatataatagcaaggattacgatccagcattacagttgcaatcggctgttacattacaactgtcgtcttgttgcgcgaggctgaattgatagacaaccgaaagttccgaaatccaatcaatcaaatggctttcttttttcatccttcaatgagaccgtcacatttactgtattcgacatttgtctctaatatatgtccgatccttctactacccacccagacaatttaggaccgactcagaccatcgccacatatcacgctatctgtgttgcacccaagctttcggccgtttccacatcctacaaagactaccttgcgagatcccaatatctacaccccacacggtggggatgcagcaacaatgccactctacctacttcatatcacattcatgcatctgaacgattctgaacgattaggttccgtccaaaataagcttggtttacgagaatgaaatatgtgactggcccccagtaggattctgatgtaaagcagtgtaatccctcgagaattcgggtgcgttgtgcggttattctctgaggagggcgtgtcacctggcatcccgttttggaatttttcgcgaactgtgccttgtagcaaggtcaattgacgccggtcactcaacccggaaagtggtattataaggttgccatgcttcaccgagcaggtagggaagctgagcctacgaaagactttaggttgatcggttaattaggtgtttgcattcctactccgaagtaatagctgccgtagggtatcttattcgccgctaatagattgatttttctggagccacttcaagaccgttcgtggcctagggaacttaagacctggatagtacaatcgccgctttcactctccaaaagcaaatattttccaacagcaactacgaagccacagaacactcgcaatgcattttctttgcttacatggaatgggaactaatagcaaggtacaaaatccttaactcaccgtgggattctaactcgctaatatcaacccaaggtcctagaaactcagaccggtaggtgtttaccctgaatgactgtctcgatgcgatgtagcccactgacggcctcgacaaaagctgcactacgttatgctcttggagatgatcatacgtatgagtttgtgcagggcgttttaaagacgagcatccattctgagatccaagacttcttcccccagggggaagaatactttgagtatttcgatctcagtgatgtctccagctgccaagaggctgttcgtcatctagaagacttcatcatcgcagagggtcctttcgacggtgtcatagggttttctcaaggagctgctctcgcagccgctgtcatggctcagcgccaaaggaagcaacctcttgaagaggctgcaaacccggtcttcaaatgcgccatttttattagtgcagccgtggtgttcgatccaattagtctaggagagggctttctccgcgcactctcttgggacgtggacggagaggtggttcatgtaccaaccacccatatatggggacagaaggacccatcgcccttccctccaatattggcaaaactttgcaataccactacccgtcaagtctacatacatgacggcgggcacggtattccaggctcacacatgggcgaggccctgggagaatgtgttcgagttataagaaggagtattttgagtgcgaagcttaggactatttaattcactaactgttagctatataaatagccctactagctacatttaccggacccaatctgaattctttcacatgtacacttctgacgtctatgagagttcgtctcgaagtcattaccatctttgaatgatacgaggagaccaattcaacatgatgaattctgttcaacgccggggaatccttggaaggtgcagagggcgtctttctacttcaatctagtagtgcatacaaactttgttgctcttataaatataaacatagtctaaatagctagctagaatagtgttatataaactcccttctttttctgatgtccttcgcagacgtcgtacgctaacaaggtgttttgagcgatatgctatgtgtccattttgtaagatctgtcgcttatcggtgtagatgttctaatccaacataactggttgccgctcccacatcatgagagtgacagggaattgagctgcggcgaacccaatcagaatccgcatctgcaaattaaaactctcgacgaacaaacgccgaacaatctcctgagatgacggaggaagagagtcgattgaggctaagtccctgaatataaaagaaagttgttccacagacacgagcgaggagagttcgtcacgtagccacttgttacccaccgcagtggctatactcaacgccgttgcaccaccaaggaaacgaaattgtactacagaagaggtagctgtggctatacaacgtgttaaacatatttacacatgggtgagatgcccaagcttggagactgggactcacctttatctcgctcctcggtgatgtatggcatcatcagcgtggcaaccccaatgttcagacctattccgaggcctgtgagaaccatcaggccatataagcccttccagtcaggatcttcaggagagccgcgagacaaaaagatgcagccaatcagctgaaacgcggctcccacgaaaagcatatatattgggggcaggcggcggttcttggttagaccagcaacgagcatggcgccgacttgaatcgccagggacaaggggatcagccgaatcccggcttgtagaggcgatactccgactgatgcttggtacctgaccggaattgtaatgatagaggttgtagagacagtgccagccaggaaggaatttctacagaaagttaaaatctatatgataggagataaaaagctcagtagctgtcacttacatgatcaaccccataacaacgcgactctgacagaagcgccacggaaacacggggtccggcccaccgtcccgtgtagtaacataccactgagaggcaaggaatgccatccagaagaatgcggaaacaagtagcaagggcagaacctgcaccgaggtccatgcatgcaaactagctgcctgctcgaagcccgttatatataaagtcatgccggcaagcagcagcacggcacccaggaagtcagcctgccgaagggagattcgcttctgggcatctggactgttgtggaatgggaagtttgcaggtatcgctaagaccaccagcacgagcgcgattacaccgccagggacgctagattgcattctggtcagccatggaaaacccatatttgtttaaagcggaccaattggtgacttacttgagcaaaaatacccaaatccagctggaattatcgttgataaggccgccaaatattgggcccaagaccatggcaagcgcaaacaacgacgtgattagaataaggtaagacggccatttgtgcgtgggaagcatttccatgacgatgacgatggaaagagcatagactccgcaccctccaatgccttgaaacgcccgacagacgatgctggagggctggtcagcatggggaaaatatcatatcaaactatccagaaggagcggccctacagctgaatcatggtctttgcggcagcacatgctcctgaaaagattgtgaagactcccagcgagagtacaagaacggacttgcggctgaaaacatcgctcagttttgcgatgataatcataaagcttgtataggtgagcagataagccgtcacgacccaactggcctgactgaagctcttcaggtcgttggtaatggaaaccagggaggtgctaatgatggatatttcaagattgacgagaaacataccaatgcagagtctaggaccagtgatcagtaattccaaaacttcagattggagagtgataggagtcccattattttggaccttacccaacagtgagggcatgcagcttccagccggtcaaatattttgcgtcgccatcttggagcgatatttcttcctcgcgactggtgtcagtggcatcggcctcctggggtgaactggcgactgcaggcttttcagatttggaactgtccattttgacacgtcagaggggaaaggtgagctctaagctggagaaaatccaggagctagggattgcaggcgggcttccttaggggtagaaggtcaagtagcttggaagagtcaaaaatggccaaagactaatctgcctagaatcgtctagatgatgcaagcggtagcagcaagttagcagtctggtacgtggccataacagcttgccctactggcctgctcacaacgtggtatcgcctgtggttgccatcatgcgttggttcgcgttgggaggcgccaagcagtgttgcattaagcaatgtgacgctcctcaggccataatatgcctttcctcgttggttatctcggacgtttccgcatttgctcagatagcccccaatgctacatcacttcagtagaagtccctttgattttttttcaccacgtaattatgggttgacgccttatcagtgttctgagggtggatggtgctggcgtgcctacatcgactgtagccaactgcagcagaaatcgaacagggtgtgcaaggcaaccacgacatgcaatagacccgaagcatatgaatcctggcgcttagaaagatggtggaggctttattgcgtaaatgttacgggaaatggaaaggtggtctaatatgtgcaatacgccaagaagggcagggattggttttgccgaacttggatgcccattctgaacattcgccttgtgaatttacacacaatttcagctttacttgacacgggaagaaaataaaattccatatgtgataggtgaatacgaactggctataatcgatcctccgaaacccacttacgcgtttctcccgccttgtcaactagaaagggtattctctcaacaattttcccaggtctctcttctcccagacctgtcgtctctggtacttttacatgaatccatattactgttcttgatatttcctgggtaagataggtcgttcaggggtaagtaggtttcggattctgtcctccccttttgctgctgtatagtcgtctttattttgatcggtgatagcgggctgcggtttgccgacaatgaagctttgccactactagaggcgtccaaggttgatttcttccgcccgtaatatgttgatgaagaatgtggcttcctcgggaggcagtacttgaagagtacttggatgcttggtaggcaagcacagattacaccaacatccatctcgatggctgagatcattccaatatcaaccacatcccctacacactattagcctaggttctatatttctttttcggactggtggaaagtcggatttgtccatactagtttggttgtgcgagtgagcaaattcttcaatcaagggatacctgaggccgctgacaacaatagtcctagagacacgttagcagaagaaaagcccgatgtgattcaaagtaagggtctagttcttaccccattcccaccaggaagataattgagatcagtagcttcttcttccaggaaaggttgaggcgaatgacaaagggtatggagacaaccagctgccagaaatcgacgatgacagagagtatcgctgtagatttcataaacatggacagattgatacagctgccctggtgttcgccatcccacctcagccagtgataacttacaggagtacactggaagatcaaggtgagaaccagagcagctgatagacagttcacaagaacaaatgtaaaaatcataacaggccgagcattaccaatgttgaaaattcggaaatagaagagtataatggaaaggcgaacaaaggctcggcctacaccatacatcaccattgcaacatagtagcgctgatacaagttagtataatatatttataatagccctgcgcctacttaccatgaacaggaaggtaagattctcctgtggaacggcccagatgtcccaaccgaggccattgtgtctctctttggcggatatcagcttttttttatctatacacttatgagtagggctagccttaccgtgtagaatgatgactgtgaaggcagtggtgcatatctaatttagggttagtgggaagtaaactctcggtcaaggcattcaagccacataccattccgagaatattgcaaaggtcatcccaccaatatcgagcacccatgacaagtcttgccagcaggcgcaatataacagtgaggcaggtgagagctaagaatgcactcattattggaacaaaagagtggtccttctctggctcaatgccacagagagtatttgtgacattcaatgtcgctgtgagttgttgagataatttagcggctagacttgaatgactagtagctaggagtgagtaactaacttagcgtttctctgacagtggaagtagatgacacacaggctttagcctgagcatttaaagcctcgtcagcacatatgcatgttgtattcattccacaagtagacttcagtatagctgtagtaaagcatttcacctgccaaaatggtttttgtgttagcacggaggccctctcaatggcttgatattaggggaggctaagcgcactgccggatccgggaggagggttacaatctcagtcagagaggccatgatatcggtatactggtaaactatcgacaattatggatagtacggctctagaatttgacaaacgcttcgagaggaggaggaggatgagtctgggttattatcagtccaaagacgcacaaggcgtatgatacaagggacacagagtacagtggtcaatcaaaatgcacaccatgccccacgtaaatcctcgatggatagagtcgcaatcttataaaggcaccctccacaagactgtagcattatgaaaattgatccggaggttgtcccgatgatgcaacgctggagaaaacaaaaagcccaggtgagcctagttcagatggtctttattggccacttgcatggtgcagatacatgcatgaaacaattaaaatcctacttggaatgcttgtgagacatggggtagaagtggctgattggtggacgtatatattgcggatagttagaggtagacgcctccttccatcacaccataatggagaagaatatacgacccaagaggaggaacacaaatcaggaaggatgtactttaaaattaatagatcaattgcgaggaagcactttgtatttgaagcggcgagagataacatgcgtgtgacaaggttgtatccttctgcctttggtgtatgtagtattggaccgttgggtacatgtaaacttaactttgtcctgcaattctagtatcaatattcagcgtcgtccatatgaccttgccgtgcagcgcaggaggaaagcataccatagctagaatgttgattctccagctgtgcatttatgttgaggacatttatggttagaaaatgaaaatcattctatctggagttttatcaggttttattattctaataaatattattaggtatataattctaaatatatttatactctaagttactcctaatttaaattctaaatagatgtataaagctaatctattaatattaactatttatcttccttaatattagataaattattatatatagagaatctttagaagaataattacttagtaatttcaataataataaacatgttattatagaataaatactttaaatatttattaataaataaatttattattattatttattaaaactaactccttagtatttatatattaataataatttatataatattaagataatctagttattctatttagagtaactttaattagttatatttcttatctactatagatctctatctagtataaattatctaattattatataaataaataaaagattaatagatatacttattttaaaacttaataaagagcagctttactgctctatatagctagatagaatattaatttatatatctagcactctataaccagagaaaatctttaaagaataaaaaaaattacattatactgttagaagtaggaacctaaggtgccgagggcacgaatacttatacctcttaactaaaaccccctcctatcctaggcatcgttaagcttcctagaatctcccattgcccaagaatgttcacactcgatattatctatcaatctctttgcttctgcatctcgggccttcatacaaacttcatactcaattggttggcttattattcctgggctgaagttaataactgcatccacctcctgctcattcctggtaactttggaaatttggaccacagctagtgatttagtaatagtcaagtatagagttgactgagcaagaaaccggccaggacagacccgacgaccgaacccaaatacgaagctgccagggtcataatctggctccattgtggggtagaaaccgatcagggttaaatgacatcggttcacgataggtgttaggatcatgtgtaagcgacctgactaacatcagcgaaagcatggaaatagacgccgataactaggcttaccaaatgttgcagatgattgtagcttccctgggaatttgataccctctgcattcggtctcctcggtagccatgtgtagtatgcccaagggtgccaccgggtactatcgcaatacttctagaatcaaggtattgatatatggaagtgcttctttatcatcgagcgtcggcagccggtcggttccaataactcgatgtatctcttcccacgcttttccttgaacgtctggatatagtgctatagctaagtagaaggttcggagcgcggaaactgtctgtgacacttattagtataagcctttcataagcccagatatgacattaccgtatcagccccggccccatacatagttgcggcagtccacttaatagtgaacgcttcctctgtggtaggatcacagtctaactggttgccttccattgcactgggcgcaatgcccatgtagctggcttgggccggtgaccatctttctgaggtgtttgaaaatccaaatcaagtaggtaggttgtggactaggtcgcggatgaacaacatcgagagttatgtcgcgagttgtttaaccgattagataaaataatttatttcttagtctcattctttgattgggctatgctgtttgctaagcatgttagagagatacataacgtcttcctagagggtaaatataagttatcgagcattgacattacttggtggtcgggcgggactccataggcggcgaggatatcattctcggctccaggccgttgatggacacaactgggacttgatcccaatgatgctttgtggccgggagcttcgccctctatacaaggtttaggtctgaataatataacatagaagaaaatgagtagctgatatcaattataatgtcagattggagaagcaaatccggcctgtgtactaggcagagttatccctgccgtctagctaagtagtattaccgggcggtactactatactattaattcagtcttccaatattattaaaaacaaaaaattagactggggccattgcatttcggtgtgggtgcctggggtcttaaaacttgaggccccgcaacgctctatatcgtcgccatattcaaatccatctagttttatgtttaaccaaagtgaaaacatatgaagatccaagaataagtgcctatcagaatataataatagtttgtttctctgcagtatcaaacaacccgactgacctttcagtaaactttctcttattatgtattcctactcactcatagtgatttatacccgaggttaatttcttcaaaacgagaaaaaagctatgatccaaacctccgattttaaggcaggaatatgtgtcaccatcaagatgattcaaggaatcccaatgatcccacataatactatgactgccactcttatcatccacaagcttatggtcgactcggtcttgatgtgaaccgtctatacgcttaatctgatacttttcgcccgtcgcaatgagaccatgaacaagtggggctcgcacgacgaggttagcacctttgcgtagctgaccgtatgggctattataactcaaaggttccacgttgatttcgacaatttcaatatcgatcctaccagggctgctagaagagcaactcacatgtccctcgactgacgcccagctccaggttggtgctctccactccgatgggcgtgagtatggtgttttcaagcttgaactctgggagggaccgagataatcaaatgtatgccatagtagctctcgtgagaaatctctctcccacataccagcgatatagcggtctttccaaccgaactgcctctcgcagagcgttgcgaagaactcagccattcccgctagggcaggtaaacgatctccgtgatagcggatagtgcgtgacgtgaacaatgagacaacttggcaccacatttcacgggcatcggattccaaaataggtccgtacttttcagtgtactgccaggataatgcctggctactgtgaagcgggcttggatcagtgcggcggcatgcacacatatggaaggaataacaggtccatattaactcgttagacgtgtatggcaaggttcttctcgataggagtgattctttcaatgtccacgctcgacggttaatgggttctcgttcatcagatatgggcatataccagactccgtgaacatgatcaagttcagtattgtttctgacaaagaccgatcggccattcagttgtagttcctggggtggcttagctagtttttgctctgcgaagatgccatttgagcttccctctgcttggtctgctgtgattgtcaaggttgcatttaagtacacttgatgcaggcgccctgcctccgcagcccagtcttggttattatcttggatgatgcatagcgagtcaatccagatatattggaaaccaagatacgcggtgatgaatattgcgtctcgcaatgtggcaggtaaattagtccagggaatagcccgcttgtgttgtgcaaagttttgagtagtggttttaaaagggggatgattaagaggatctccccaacagtaacttagcgcgacataagtcccaagggcgccattagtttcaactagaaaaggatcctgaagacttgtggcacttgctccgatgccaattaagcgggtaggtagtggtacaggttcagctggatcacaatagatgtgtgctcgagactcggtataccctaccaagcagtcttgaagccattgcgcagcaatggcaagattagctggtgccgaggaatggctccctatttctagcgatggacctagcatggggtaggatcgacaagtatcagcactcttttcatccaagaaagattcaatccaagttaccatcgcgagaaaaaagatcaagctcgacatgccgttgaaaatcatctctagggccaaaagaaagagtgagcggatggcctgatttccatttggcggatacagtttcgtctaaatcagcctcgctaatctcggatatgttccatcccttggaatcagactgccctgcaccgagattaagacatattgaacacggttcttgttgtgtagttgtcgacgctgtggtttccattttctgatagtcaggtatctatactatggactggacaagagtgagatgtggggtacaggaaggataacagctaagcttctttgtgagacagtaaagctggactttataagaagcagttctctagatacggggcctctttttttatttttttattttttatttttttggaaaagatagtaagagtactcgctgtttccagcttattctaataactaacttaagctatctagctgtttacctatactaactctctcaggagctattaatacttatttatttataagctcgagctctttatttatataagctagtttacttagcttatttcttagctatattatctttatagaattcttagaagaaggatttctaatagcttatatatcttaagaaataaagagttctttcttctatacttttctttataaacttatactactaaataatctatataaattatactatagatttttatactatctaacttagtctctgtattagttctttcttttctactatatatatactataatctatatactatttttaaattatttttaaaaatagtttatatattattatactacttaactataactaatagaaccttaataaatatagaagtagatagactgggcctgcttttataggagatatatcttgctctttaacctatatctagcgcagttaagacttatcctaacaggaggtaacctagactattgaataaggtaataattctaactgtaagatccctggggttttcctctatgcccaggggatacctatagtagttaataaaaatatatataccggcttgaaagttataaatagggccagttattcccgatcctaaattcccgagctactatattgtggaagatattactatctattttagtccgctactagatatattattagagttataaaagataaaggatttagtaattctagcccttctaactagtactatacttatccagcttattatatatactcttaatctagctaattcctactataggtttctcttaggaaaatacttataataagagttatttattatttctatatttttttaggggtttttactatatataaggggtagtatcctaagatcaggctatatataatataatctatataattagtttttaactaagttctaatctatatctaatctttaactctattttttttttactttttattatatagctaactaaggtataaataataataactctaaaaactttaaaaagagcttattaaatatataatttagctataagctctaaaagaagatacttattatttataattaattataatatctctttaagcttattattactaactatcttttcttataacttattattaactatcttttataataataataatagattttctattagttttactataaataaaaatagatcctaagattaaatagtatataatctaatatatattttttaaaaatataattagtagtttatatctaaacctttaatactataagataaagttaaatattatactttcagtctagatatctttaggggtttttactatatataaggagtaatatcctaagatcaggctatatataatataatctatataattagtttttaactaaattctaatctatatctaatctttaattctatttctttttactttttattatataactagctaaagtataaataatagtaactctaaaaactctaaaagaatattataaataaagacctttataacaggttatatagttatatataccctatagtctgaaagatagaaataataggagcagtatactcctattatagaataaaactagattactagaagtagtatacttcttatactctataactagtatatatatatatttattttctaaataaaaatactcttttaaataattattaatataattatctatatatttattattactagctctataatatatatatattaataataatttatattatataatttataataatctaattatactacttagaataattctctaattaatttaatcctaatctactctagatctctatctaatataagttactaactattatatattaataactcttatttagctaattactttatcttaattactatataataataaagaaaatattataattactctaggaactctagtttaatagaataatactataaaactatttactacttagtagattattaaataacttatactttaaattaagagttttaaaaagaataaattataaaagaattagaataagattattagattaatattattaaaattctttatagaaaatatttaaaagcttaatagatttagaatttagttttaaatatactttaagttttttttaataaaatttaaagaaaataagaataaaattagatttataggaatatatcttattagaactataaattattagttttaaatatatttttataactagtataataataaaataaaactagaactataaagctagaagattattaatatttttattaattataataattttattattattcttattattatatttagtaaaatagattaaaaataataagttataaagaaatttaaagatcttagataaatagagattattttagattatataataaaatttaaaaagattatattttatttagattagaataatatattctttaaaactatattttataataaactaaaagaaaaaattaaaaattaactttttaaacttaataaactagaaaaactatttaaatacatagttattataatatatattaataactatctttttaaataaaaataataaaaagaaaaaaaataaaatagttagaactatattaaagtaaattataaatctaactagaaagtataataagttttactactatctataatatctagaatatatatagatcctatagagctagaagctataaagaaatagaaatactataattataataagattagatatattttattttaatatctaaagcttaaaaagcagaagaattaaaagcttactaaagaaagtaaaaaataattagaaataattagaaaaactaaaactaaaactcttagaataattagaaaaattacttaaaaagtaaactttataaatactataattcctatattttttagaatatctattactatttttactaagatattaaaattaaaatagtactaggattagaatatattataaaaaaaataataataaattttataaatcttttagaattttaaataaaaatataagtaaagagaaaatattttaaaatatagatctcttattagatataagtatatattctattatactaatagttttatttagaaaataagtaaagaataagaataatatatatttactagagataaaattaaaactaaatataataaactatatatctattattaaaagaaaatataaaaataaaatctagaaaaagatttaaaactaataatctataggaaaaatattattaatactatttaataataaggaaataaatataatatattaatttatataaaaactataggaatatagaattattttatagaattatagataatctattataatatctaatactaaatatattaaaaagctaaaataaagaataattttttttatactctaataggaagatatctattaaacttaaagaaattagaaataatctctactaataaaaaaaaatagagtataatatataaaaaactaattatactaatactaataaataaaattaaagaataaataaagaagttctaatagtatttatttaaaaagataatataattaaatatcttaaaagaacttcttttttatatattaataaatataaactaatataaataattaaagaaataaattaattagataaaaaataatctaaattatttataatagagctatagtatagtataatactaataatagattagaaaaccctagaaataatagaaactagaagctctatttatattcttataaaaatagagattaagaaaaactagcttatagtatttattaattataaagtataggaaaattatatcttactagtagtaattaattaactctacttattataaagaaagaagaaagaaatctatataataactaatatagagagtttaaaatttaaatataataatagaattattaatttagaaactaattattttataattaaaattgcagatcgacggcacctccgtgtacgacgcccaggtgtcggccgccggggccggcggtgccacgatggacatcgccacgaacggcgcgcaggcggccacggacatgcccaagatcaacgtcacccagatctacgggtcgatgcccgtcgaggtcaccgtcaccaacatgttcgtgacgagtgtcaacggcggcgtgatgaacccggatgtcggccccagctcgacaggctcaggaggtggtaataacggcgggagcactacctcgggaaccaggactggctcgtccactaccagcactcaaagtgcgactggtggaggtaacaacaacaacggtgctggccattcggctcttgacgcttcgcggtcctccatctgggctctttgtctaatggttcccgccgttgttctcgctatttgagatgggccacaatgaggagagtactctggtcgtatgctcgcgacctgatcttaacgcaatgtccccctcacctggctcacaggcttaatgatgatgaagtacgtattcgacacgactaaatgacggtcttgtcactccactctcttggaaggatcagcacatggcagcggtgaatttattccagttctttctctctctagcgcgtcggcatatctttctttcttggatttctttttgggtcgttttctgttgactgcatctttccttaacataggcacctcttagagcccgttagaaagaagaagaatatactcatgtttccgccacgggcagcggactccaactccatgctgcaaatctcgtgatccctagcgctgtgatactgtgtcagccacccattgggccagatggctgccaggagccagtccatttggagaaggttctccgttatcttggacatgccattgcgcatggattgatctcggaaagggttgcatctgatctgctaccccgctgcagcccctggatgagacaacctcgtactctcctccaattggaatgaggatacccggtctgcagagtgacggatgagcgaagacccagaagagcgtcgagatgtgccgccggaaaggagccggaagacaactgggggcagcagctgtagtgctccacctccgcactaaactacaggggcctacaggggcctgcagtgggcctctccccagatccatcaaccctgcataagcggacgcggccatctcacagccaaggatggatcttcgcccgctggnnnnnnnnnnnnnnnnnnnnnnnnnnnnnnnnnnnnnnnnnnnnnnnnnnatcaaccctgcataagcggacgcggccatctcacagccaaggatggatcttcgcccgctggtccttgctttccagcttgccagtgcttcggaatgtggttacattcgcgaatgtatttcctgggatgcgctcaatccaggaggtctgttcgattctagccttcggttgaccggactagcgtgtggtatttaaagcctgggctgtcttctcaccgcccggtccatctgcctctgtccccctacacaggctgcgtcagatcacaaccagggctctgagacagaaaaaatcccagctcaaccacagctcaccacactcgtaggagccacctccgccacaagaaaggctcgacacacccgggcaaacccgcattccattccatttcttggcagcttttagtcgccagaagcgaagatggacaagggcgaggtcgccgatttggcttccttcaagcatgtggacgatccgtcccagaatcccgacagcgggatagctgcgactgataggtgagttggaattctgtgattcttttcttccgtttccaggtttctaatatttgttgtgtttgcagatacggccatgctttggtggaatatgacccagcgaccgagaggcatcttcgcaacaagatcgacctctacatcgtgccaatcgtagccctgctctatcttttctgcttcatnnnnnnnnnnnnnnnnnnnnnnnnnnnnnnnnnnnnnnnnnnnnnnnnnntcactctgtctctacaagaaattgtagagactggctgttgcaatgactgcaaactaactcatcgtgaataggcaatgccaaaatcgccggtctcgagaaggacctcggaatgtcgggctacgactacaacggcgtggtctccgtcttctacgtctcctacatcctcttcgagatcccgctgaacctgctctgcaagtggatgggccccggctggttcatccccatcaccaccctcctcttcggcatcgtctccctgggcaccgccttcgccaccacgctcgcccagctctcagcagtccgcttcctcctcggcatcttcgaggccgggatgatgcccggcatcgcctactacctctcccgatggtaccgccgctccgagctggccttccgcctgggcctgtacctggtcatggcccccctcgccggcgctttcggcggcctcctcgcctccgccatcctcagcctcgaaaaattcggctccctgcactcctggcgcatgatcttcgccatcgagggcatcatcaccatcagcctcggcctcctaggcctcgccttcctcaccgaccgccccgagaccgcccgctggctctccccggaggagaagcgcctcgccgtcctgcgcgtcaagtcggagcgcgtcggcaacaccaccgtcctcgacaagatggacaagcgcaagctcatcctgggaatcacctgccccatcaccctcagcaccgccgtcgccttcatgctcaacaacatcaccgtccaggggctcgccttcttcctccccaccatcgtcggcggcatctacccccaggcctccaccgtccgcaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgcccaggtctccgccaacgtcgtcagcgacaccgcccgcagctccgccatcggcacaaacgtcatgatgggcaacatcggcgggctcgtcagcggctggtccttcctcccctgggacggcccggactatcacatcggaaacgggctgaacctggccgcggcgggaaccgtgcttatcgtgtgctccttgacgctggcgtggatgaatcgggataacaagaggcgcgatcagattgacgtggatgccgagttgagcgggctgagcgagcagcagattgaagacttggactggaagcacccggccttcaggtggcggccataggtcgttgaattagtagcgtagaaatgcaggcccagagtggtcgttgagggtagcaaaggagtgcttaacccatcgtctagttatatcagagtatagggcccaaatggagtagacaggttgcgaggttgcctcacacgttaacttgaaataattctttccatgtaccatgtactagtgatatcttatgtatatcttatgtaggctgcgcagcccttgctgagaacaggcaggcaacagccgcctctcgcaactttccatcacctcctcacccccgagggcacgaaagaggccagaattaccctctccacagcttcgcgtgaagcgacactgcagtgaaagaaaagtgataactttcgttaccgggttcacacaattcaccccggcgtgaagcgacagacagcaagctgtctctcacatcaggccagagataattaaccatgaggggattgttaccttggaagacagacaaaacctatgggtgggattacccagctcatccaattggaagaagagggtgcaccacgtcaccatcggcgacaagccgagatatcctagagataagctgcatagcatagaaaatgaaaagaggacatggggacaaagaaaataaaagggaaaagtaagcttcaaattctatgttagttagtactcgacgggtgtgccgaagcctccgatagcagcaaggggcaccggcaggcttcgccggtctggaactcccgaatgaaaattcatcgtaatatacacgtcttatttgatccttttgccactcgttcggtcgtgtcgagtccgtccaatcctatatcgtgaccgtccgcaacgccgaaaaagtcaaagtggtatcatcgtacattatcgtcatgaaaatagaggaaaatcaacatgggcaagacgcatgaggtcgacacagacaagagaaaaaggtcgagcttaatccgagcaggggccgatggtcttctcgtgaatatgtcggagaaagtctctttgctttcggaaggatgagtagttgccctctaaaatcacatcaaggataccaccagtggcccggccctcgccgatcgaccttattctttcactgagaagtgcgtaggcttcgtcgaacctagctacgatagaccgagtgttggaagagccgcccgagatgtcgttggatgcattgtttgggtcgattatggagaagcgtccgttatttctgtaggtcaagctcgacacgtccgactggatgtgcggcttagttagccatgaggaacatcaataaaactcggatggaatgggtcaacacctgttggatcacggactgcagataggcaaaaattgtgtcgttatattcatctaaattatgcatctccgatgcttccggaggaaatncagttagtggttttaaccgctagtagcagctaaaaccccactaatttatagaggctataacctctctaaaatcaacaagataaaagtaggtcttataaaagctatatatatcggtcgaaggttttggtagttgtgagttgattttttagatttcctatagtaatgaattttacggaaaatcaaaagtggcccgggaagcagctttagcggggtttagagtagtttttagtcggtagacctatgagagaaattagatagaattttctggtctctctcacaaaaataagattcttttgcgctatattttgcactatattaggtccctctagcactaaaactcactgagtaatagcggagttagcagttgagagctgtaagttatagcgaacttccctgctgcgttatagcggtctcaaggactaatacaccttgaaggccactgtaatttcaacaaaagtaattaatatttaatagctaaaaaagataagagaagtagggagatatatagactataataatcttctgcttttaatagtaggttttaaaattagctaagtagtagcttttatagctattaagaattagtatttagaatactccttttatataaggagctatataagaattaaaatacttaatctaatttagactaatcttattaatagtttagctatttttagttattataaactactaattatatagtagattatatttctaatactagttcttaagataatattaagtaattagaataataaaaggaggaatagtctagctagctatatttacctcttagattataattacctactcctagttattaggttaaactagtttagtctttatataatcctctaagataataattattattctagagaaaataacttctattataaagctagttttattaaagttatatagatttttatttagaatactatattttatctttagattatatataagagtaaattaaaatttaataatctttagatctttatatttagctctctaatagttatatttctaaacccagtatatataaaactctagttactacttaataaaattagaagcctaattaactctaatagggggtatactatatatatatagtagaatattagctattttcttaatactatatatcctagagggaaatatatatatagatagcttaattatatataagataatagccttttctttagattttataagatttattaaattagcttaagtattatatcttactatataactagtatattactatattaagattattcacctaaccttataggtcttaactacagctcaaagggttaattttaagttatttttaagagcttagatagtaagaagtattcttgatttatacggaagctctgttatattgtattatagaggaattaattgaattagataaagatagataaaattaatagaagtagcccgctcgcttgtatggcccgctcgcttgtggattacgttattcatttgttcttttagccatatgatttatacaataaatgcatcagcgacatgcgaccctctaaaaacataccatgaaccaactacatttgaatcattaactctatattaaatccgaatagctgaagaaaactctgttatagtggtgcgtattctttcataaataaaaatttagtactccatcttctaatttgttatatttgtttcgtactaataaatgatgaccttcgatatagggtagccatcagcactttgaaaaacgagtattatttttttaacttgttgccaaggattttagagctggaaattaaggcttcgttatttaaaccattctttcagttatgctctttgtctaacgcatcggtgatacaaaagatatagtcaaggcacagggagtgaccgcttattgaaggttccgggatcctcggcgcccaactatctcagcccaactgtgtgaaaaaacggtttaacccacgactattttagttgttgcatttaacacataaaaaggacccggaattttatccagaaaggtaaaaaccagctataaactgttatttgcaatatatgctatgaaaaacggccctaagaatatccacacttgagtcattgaaaacccccccctgaatgtgccctttcactgacgaccagcaaatcccgaagactaagccagccagcacaaaaaccaaggcaacaagataaacactgctggtatgccaccctctcttgaagtgcagaccccaacatagaacctcttgctctggcgaggccacgaggcgtccacaagtccgttttggcagctgcattagtatgctcttttgcctcgagtcaatgcagccgggagacttgagaaaatgagtaagacgactagacgcaatgacaggcgtggtctcaggccgttggtgtggtgctgggccacaccggtattcattatcgatcctgtcacgcggcgggagacatatgcagctggcagagcaagaaagatgatgaggatggatgtctgtaaagccactcatatcgactctgaactagattgcaaaaagagacgcattgggttagtgtacaggcttagtggtcattctatggctaggagcaaaataaagtcttaccctcgtcaaagaaacgagtttcactgtgcgaaatgtgaaccatgtttttttttgttccacacctcgaaataggcagagtgtaaaaactgaaatagttgccgatccgtttggattgtattcaactcattttgaatcaatatcgtctcattaaggctcttttcaacgcagagtaacagatggtctgcagagacagaacctaacgtagctgaaggatttgttgttgtactctgcgtggagttggatggtgctggattcttggtaggtagaataggtccagatattgagatgaatttccgaactgctccagagagtgagtggccaagtgataggatggcctgggtagtttggttgatagcctgtctcgtattaattctactttccttctgagacttttgcgctcccgagtcggtccagcggatgtcattgtcaaaaacatcatcgaaaaactcaaccccgcaggtctggtaggcaacaagtgttattgtgattacgaagatgaaggtgttcttgcatcattgaacttacacatttccacctcgttcgcaccatgccatccgggactggggactctttgaaaacgcttggaaggcactggagaatattctcaacgaaaaggggcagcgaagagtagaatgaggaagctagtaaggtcattgagcaaatgcatgtgtatggatatagagcagagataaagggacaagaaactcacggcttgattcattttgcgaggaatcagatttcacctgatcagtagtcagaagctgtttctgtgaatgtcgagttgtaccggggggcatgtgaaatgttagtgggatcgaactgtgactgccgcgattgagatcaacgacactgctgcagggagccgaagcgtgtgatcgcttcattctagtgtcgtgcttctcaaattgcctagacaatctttcattttctagatagagatcgttgataattttgcttatcacagtggttctagtccgtgatgcagcatccagggcaagcatttgatgctcaatgagatccagcatttgcaccagaaaccatgagcaagccttattttcttttagctcatggatccattgaataactccaggtttcaaaatagctcgatcacgatcattttctcccttttcaattttgaaaagggggttcgtctcccacatggtggagcccttttccaatcttgcctggcagaatttgacctcaaccgcctcagtccccagaaggtaccaggtaatgtattcgagaaaaacacaccccagactccagatgtcggcagcgggtgttaccaacccaccaggtaggtcgaactctggtgctcggtatgtttctgttcttgccaaagttcttggatcttctccacgccgtgaggatatcgagtgaagtcttccgaggccaaaatctgcaataacgagctaggggttgtcacctgcgttctcaaagaagaggatattctctgacttgaggtctccgtgcctcccatacatgtgcttgacatcggacaggtcattttccgggcggttctccggcctgccagtttgaggaagtttcagagcttgcctatcattatgaaggacttccagagctcttgcgagctcacggagctgttttgccatccagacttcatgattgggatccaacctatatgcttcgttcgacttccaaaattcgtgcaaatccccatttgcccagtcgaaaagcaaataatatcgtgattggcctgctcttgtatgttgttcaaaggaggcaagaagtctatttaaatgtttcttctctccgccttggcgcgccaaatataacgaaaattgtagttcagctctgaatgcctctcgttgaccagactcggaggttaactctttgagggcgaagtaacgattacgtcgctgtaattcaagatttggatgttaacactattaaaattttgtgagcttcaagaaagcactctgtcacttacatcgtcaagctcgtcgttgtattgtgaactggggatttgaaccttgtgaactttgctaaatcctccgtgttgggttatacgttcttctgtattattcgaggaaactgtgcgaaccttcaccggcaggcaatacccacgctgtaaaatgtagtgtgaatgtacatctttccggatcttgatatatggtgccgaaagaatgcaaagccaaccgataaatatttcgagatcatcgggtgtgtaatggtccaatacgtcatgtcggccatgaatggaacatgaaattggccaacctgtcagtaatagacaattgtcgcagactccatcatcgatgaacttcatgatatcttcagccctttccatcaataataagacggcaaatatcttcaatcgtggagcgcctctctcgtccccaaagcaaatatcttgcgccatagcatgcttattctcgacctcgctccagcacttcaaagtgtggataatcaggaaaaccttttcaggtgtcaaaatttctccgagtctgtctcggggaatgaaaccccctaggaggtttgaagaacactcaatccgggcctctttcagtgctgtttggatatcgtgaattagcctgttaattccatatcccgggccctgtggcggagggctaatggctcgcctcttcaagggaaagtcgcaatagaagagcctctcgccattatccttgattgtgtccatattattgaaagagtcaaaatcaatatccccatgtgatgaaaactcgtggttattttggggcggtgtctgggtaagggacgcaggacccttggtcttaacctggattgaactcttttgcggacctggagcatcagcagtggtggcacgcttggttctgctgacccgcgaatggggacttgggactgatgttctgatgagctccgaggttaaacgtgatggtcgctgaacatcaaacattattggtagaaagaatcaaacatgaaggctgctttttatgaaaagattaaaaggacgtagggttactaggatggataaaaagaagacagacttgtttgagagtcacgtcggcataatatattcattcttgcagcttctttcttgaagacgcgcatgcgcatattgtaactatcctgtcttaaatagtaaaggattacttagattttcccacagcgtccaaacgtttgcaagtatatctgttacatggaatacctcatcagtacctctttctagctgagtaaggggcatgcatgcatgcagcctacttggggaggattcagccctggtttatgccttggcaaaaaggtgctcaggtgaggagtcaaactacaaagccactacggcagtgttgaacgatctgtacgaatttataatcctaactcatcaccgacaaaaaaattgtgtatctatgtaattattgctttttctcgtcgaacaaatttgttcggaaagccaggctacctaatagtctgggcagatcatgctccctccccatctttttgaggattcagaggcgaaccacgagatcaaatgataattctacctagacatacaaattttcgaagtataatcgatggcttttagaagcctatggacacgacctaacctacgaaagatacgccgcatcgttactcgagaaaatcctggatgtgctgtatatactcttcccgctgatcaacatgtgaaaaatgtgccgcattgtttagtttcacccattttgaattcttgatattgtcagcgaaaggctgcattgtcacatcctgtgcctcgtcatttacggcgtttattaataaagtcggcaccttaatcttgtgcagctctgggattattgtccaatttcgaagcgagccagtaatcgaaagctcgctaggcccgtacctagataatacttcagtcaatgctcttgcgaaaacgaggcgcatcttacattgtcccatatgttgtgccatctgcttcaaaccagttcagtgcagccttaacctctggagctggatatggccgcgcaaggctcagatggcgcttgtagaatacttcaatagcggcggcgtattcaggagattcaaacttctggctcttctccgcttcgtcaagcacaacctgaacgtcttcggggagttgctttcgtaatgatgtaataccgatacgccaggtatccatgcttgcgagactattcgaaataatcagacgtcgaagattagaactcgactgagttactgcccattcggctgcgagcatgccgccccaagagtgtccatagacatcaatcggtcgtgaatccagaccaagatacttgagcaggttgttcagctcatccttgaaaagctccacagaccagaagtcctcatcaccattcctttcggctagatgggttgactttccattgccaatctggtcatagaagataagtggtactgagagatccgtcagaggcaggaggtagtcgtgacaggctccaggccccccatgcaggacaattaatggggtacatttggagtgcaaatcgccgatgatcttgtaccaggtacgagcagactcggctaggccaggaacatgaaaaggagcgattccctcagccattgtgtgtgtcgtaatgtgaatatttttcttgaaagaatacgaggggaggaggcggggtaaatgaagagggcgagttggtgcaacgtcaatgtgtgcaaggtttggggaaaagggggagccaacagtagtcgagttgatcaagtgcatgtacatattaccaaagttctccgcttaattgataacatgcatggcggttaaagcgaatgcaagcaaacattaaggttttttatatgatagcggatcctgtagccggttacaagtggttatgtctttcgaattgagttatattcaaatgagaaatggttcgaagtatgaagattttggaggaattccaactgagattcctacaattcttccagtaactagccatagggccttcaataaatagaaggaaacgtgccgaatgttacattgcaattatataaaatagtaaaagtaggtaaatattagagagagagattcatattttcagctcggcggcattcaagtgggcatgtgataatcatctgggctgcagctagccacccccaggtaacattgaacaccacactcacaaaggtgggtaagagagagtctcgggaccttgctgtgagaaatcatctgacgaaatgcgggactaggctcagctcaccgttgggcgcttcgaagttggaatgggcaaacaatcgctcagcaattttcaagcttagaaaacacggacccaaacttctcctaagatcccgacttcgagacccaatattcgaagaatttcgaaaccggccgaacctcgtcctgtcaccggcatgcagctctcggagattctggctagttgccagtcctggcccaagctgaatgacacgcggtacggccttgatccaatcaatcgacttctcccctgtaagatagccagaaacggtcgggacaagtgatgcgtgccaagatagaattcaggcgagacgcgcacctcgtgaataattcgatcaatctagcaccttgaccgccaatcaaggcagtaagcttgtagaagaaaatattaaatgctgggagcgtgcagaaatttgcgtattgggatagctgaaagatcccaaattttctgatttggctaacatgaatggatcttcagctggctgatttcaataattctatgcatggctgccgaccatcaccagactctgtctcacttcgtatgccttccacttcacgtagcgcgactgagctgaaaccttgctgtttaggaccgttatttggagtttagattggtgtagggcgaggcatgtgcgctttctcagatgtctactagatgatcacaaaatgcatcgacccgttggtctgcatgggtgattcgagtgcaaaagaacccttgacataagaaggaaggacaaagaagtatttatacacagtgtctttggtcgaaatttcccctttttccattccctcttcaacaaacattcttgttacagatactccagcaaacccgaactttgacccaactaccactttcattcgtctcgatacctatatatcatacatgtgagattttccactatgacattcacacatgtctcgtactaaatcagaatctagcatgtcttattcgatcaaaacccgtgtctatcagaccaacaccaacgcctacttccatgtcgtggagaagggcgtctggcactttgccaacggtggcacctggagcgatcagaatggtatcctgaccctgaccatgggcggcagcggaacctcaggcatgctccggttcatgacagagcagggaacggaggccttcttcattgccctcggcgtccacaattacaggccttgggtcgacatcgtgaccggtctggcgaacaacgttacttgcgtcaaggccctgcccgagtactatgacagcaagcactctgtgcgctgcgcttcccgcgaggcgcagcgtacttcgcagtccattctcaatatcgaccatcgcactatctccgtcgaatacaaggttgccgaaggtcacaaccttgagctcaacattgttatcggttaaggtgatgggggggggttattccagcgggtaaagatgctgagcgttgatcaattggaaagtctcgatatccaattggatccgatttgccatgtaacgctcaaagctgggtaaagagtgttcggctttccttgtgactctcccctccgattaagcaaggcagtgagtagtgttacaccgttatactcaattttatgttttgtgctatcgagattatgcccaccccattggcggaactacaacgtttcgaatcactgccggcaaagcaagacacctgggacttgcttatttatcctgtatcgaagattccatagtattgagagaaaatgcaaaaaagaaatgcgcactggagaaacggggatttgaaccccggaccttttgtagtgtatgtttaagatcatgcaaaacaaacgtgatgcccctacaccatttccccattgggacaggagtggactcttcttttttgttagatagacccaaacttctgatcgctcgtcctcctcactacctagatgcctgctctataactgagtaggtgttcagagattgagatgcgtaatgcggttcagacgaacggtaatgtcccggaagaggcataatccatcactttcttcattaactaaccgcgcgcctctttcgcataaacaagtgaaattagcaaggctcacggacctagccgttgcgcgcgggaagcattataggcaaggcagatatatatagttgcaagttgccactcgaatcaaaccaaggaggatcacctccccgacccatttaggggctaaacaagggtgataagtattaattctgtaagacggatacgcttaaagctgacagccctacgtttcacaagaggtctccagggctgaatcaggcacccacacaacttcgcggtagattattccgagcaccagtccgagcagaggcatctacctgcaccgggcttgtcgggcggcccgtttggcgcacgcgatgcccggagaacataaaaagtataaaatgcactcagggctccttattcgcttctttacgagagccactcatcaaagactatctcgaacactatcctatatatcgtacgatacccaactaaccaatatgcgcctgtctacctttatccgtatgtggaaactcccattggctataacaattcttcgcttcacatggctgacccttctcctagctctgctcgccctcggaagctcagcggctggcaccgactgcaagccccgtaaccccgatgggtacgctgccagcgatgagttggctgcctggatcggaaaggctgtcgacgacttctaccctttccgtgacacgtgggctagcgcctacgacgcatcattcgcccccaacctatcggcgacattcaacgcgactaagttcgactttaacaccctgagggctgcctacggtagcttcctacccaagctccaaggccaatacgccggcacatttgtaagttcctccatggaccctgccacaagttctatggcactgatggcttactagggccacggttactactctgttgtcgcggttccccatgctagcgaccgtggtggtttcgtttacatcactggctgggccggtggctacatcgacggcgacgcagaccgactgtacaatgtatcgcacgctgcctttggtgttgttgagcaacaagaggattgctctattaagattgcggaatggcgcgagagctccaacatggccccctcgccttaaataactcggtcgtttcattctacgaccatcttcagatgaaactgggtactagataccatgggcatgccagccgtccaatggcggcagtgagtggtgtaagccatccaatgggagcagtgaatggtgtaagctgatggtgtgagaggcggagtgggacgcggagttcgcccaaaaaactatacgagacctttagcgtcatcagcgtgagatggagtttttgttatttaaggtctttcgattccatatcttgcctgggcattgaatttgcagattgccttaccagacaattgatcccgtcgttctcctatctttactgtctataaacatgcatcttatcttgacgggtgccactggccatgttggctctggtgttcttgatgccatgatgaaaatgacagacatcacaagaatatcagtgctcagccgaaggccagtcaagtttgcagaggacaccaaagacccccgggtccatgtcattgtcaacaataattttgagaattacgaccctgaaattatcaatcagttgaggggcgccacggggtgtgtctgggcactaggagttagccaaacacaagtcgggaaagagtaagtggttaatcgaaggagtgataatatgactccatgggagactaactttgcaccagggagtatgtcagaatcacaaaaaccttcgctcttgagtcggcaaagacattccaggctctgccggttaataatgagccattcaactttgtttatgtgtccgggaacggagcaaccactaaaccaaccagccgttcagtcatctttgcccgagtgaagggggagaccgagctcgctctagcagagatgcgaaagcagaatccctcgcttcatgccttgtctgtccgtccagccatcgttgattcttccgctcacaatgcgattcaaccatacgtcccagaacctagctttccgatcaaagctgcaagatttgtcttatctcctattgcccgcacttggttcccaagtcacacgagcccaactgagccgttgggcagatttttggctgaggctgccatggggaggcatcgggaacatttcaaacctggtcccggaatcgaaatgattggagatttccccatcttggagaactcggtgtttagaaaattggcgggtcttaagtagcacgaacaagacatgattcgacctgaagttgtatcaacactcttagattgtgttttgcaaggatctccactaattatcagtacaattttactcatacgatttgcaaagtattgagcggctaaatcgtgataaccttttaattgtcctgcatgttttgggtggaaagaaattcctggtgtagcatgttcatgtagaatgatcattccctgtggtatcgctccaaatgggtgtgctgatgtgggctggccaacactgaaacctgagttttagcaagtgggtctgccagaggagattttcatcactacctaatgtaattttcacatttataccaatctcttcgccaagaatccaacccaacacttcgagagcaggccctttgaaaatgccaaaaagggatctcactagtatcacgccatggccgagtcgcagctatataccctgaagaggtcaccggatggtggacatggcttatttgctacggtggccattagggcaggcactcgcatcatccaagaacagcccgtcatgatgctctcaaaggaagaagttcagacacaatctgaagagaaatgggtaatcacaaacatgagccggttgccggttgaggctcaggacgagatcatggagttatatcacaacccgaagaaattgcaagacttcaagtctcaccacagccagaaatgccccggtaccgactgggatgctggtcttgtgctggctaaattctacaccaacgctgcttcaatctcaggtggactgaaagttgggctgtttactacgttttgccgcatgaaccattcatgcatgccgaatacgtgctgggtgtacgatgaagtgaccggaatggaagtctatgcggtgagagatatcagcgagggagaggaaatcacggactcttacaccgaagtcgcgtgttctagagaaagcagggcaagagaactagcgaattgggggttccgttgcgaatgcacggcatgcgaaggtccagaggccgaagtgattgatatcaggcggcgaagggtagcgcaaatcagagagctcttggagctctacagccgtaaagatgagaggcctgtgttttcagaggtaccgaagacggatttcgaagctttaaaactcgcagaggaaagtgtctcgttgttgtcattggaaaatctagttgaggagttgggtgctgcgcacggatggtgtgccaaatttgctcgtcgagccgggctgagggatgtcaaggacttccatgaagacaaagagtatcagattttagttcttactacgggagacattgaatagagcgatttctttgacataatccgaggagaacacatcacaaccataccagacggggaatgcctagatagccatgcaactggtaatgaatgatttcaccatcccaatttaagattcttttttcaaggattctggctttcttattctgctcctctatatagagtcttccatgaagtgtaactcacgatatactttagtctctgcgtcggtgaaccacccatgattagttgaaaccccgtcaacaccgacctcccatattccatcaataacatagccagcccaaacctcgaatatttctgcgaaccgcggcgccctaccgatgccccatggtctttgaacgttatgaaccatatctctatcagttgcctgggctgtgacaagctgaatagtgtccgcgaacttgtcgtcaactgccgtgtagagtccgggaaggagtgaaattgtgagtctctccaaatgtctctcgcgaatagtgaaaggagtctgaagcctcactgattcatcagcgagtggaagaatgagtgaagggtagaggtctggctcgtcgggaaatttcttgatgaactgacttcgttccgagtcgggaagctctgaactcatcgtggcttcaaatcttacatctgtaaagactgtaatgcccggtccaacgaatgtgaaatttggccgtttagcccgtgtaagaaaggctttagcaaaagggctcatcttaaatcgatttaccagactgatgggcaggggatcgcgataattgtcttcgcgccgatcaccaaggcgggtttggatagcctccagtaagccctcccaagcggaaagggtttcttccagatctccaggcgtaaatccccgcatcaatattgaacttctgctatcatccatccaatagtattttccacgatcccacatctccaataactttagaagcgcaaactcaagcggtacccatgactcggaatggctggcgggaaggctgccacattccatattaccataagtcactcgtttggtgaaaagatcgagaaataaaccggcatcctgctggatatcaaatgcggtagggtagagtaatataatgtctggatcgttcatatctccatatgttcgattccagaatgctactgcatcgggctgtctaaactcgcctgtgaatggcgcgtgccgtggatcataaacattcaactgggagaaaaaacgaacaatatcgtcattctgcaatgcatccgtatccgcccaccccggaggattcccaagagctatctggatgcagttctgttgcatgttctcagcggcgtcaggaatgtgaccgactgccctggaaaggagctcattgtggaggagagcgcatcggtccggatcaaactcggcattgacctcttgctctggggggttgtcgtccatcgcgatggcttgaaatttctaatataacacagtttggatccgatagtagccgaaaagaaaaggatgttgggtgattttgagagcctgcggtaccagaagaattcacggtacagagaaggggcgaggcaccgatgattaggatctcttaaaccggaacattaaagagaaaataaagaagaagaaacgagtaatttccctttccagaagtctctctgctgccaatgcacagattgctgctttgggactgaggatgtaaggtgaatagagcggtcagcaacagtcatgagttttgttttatcaggtcgtgactttacgagcgttagttagccttggcatgccatttggttttgcctaataactgcagttgattatactccatcagtttgttcaacaccaacaacctttcttagaccgtcggaaacgcacctacactcgtattcaattgcttttctcctcgttagctctgagaaaaatatctcagcaacagctaattcagacatatattgatgcttgagttgcttcgggaatcacgtgtaggtaccatacgtggtctaggttagcttagtaaactagaaccaaaaaaaaaacactcatccaccagccactccacttgataccttatgccatgtaataaccctgagaatggcctcaatcaccttgccggataacatgatcagagagaataatgttgctaagcagggctttgatgggcaggtgcctgtgaagaaacctaagactagaaaatatgcccccaaagttcgcacaggctgcatcacttggtaagttgccaagccggtgataatctcagaaccaggctcaccagtgaccgacgtgcttatgggagatcgtcaactaacaggctcgcagcaagtaaggcttcatctccccctctcttattagtgggcctgttcaagatgcttagcataatgagttcttcttgatctaacaaacaaacaaatcagatttcgccggaagaagtgcgatgagcagaagcctttctgtcgtcgctgtacagaaggcggctggaaatgtgacggctactctcctatagccaaagaatctacttccaaaaagaagaagaacaattctgccgctttggtcgagtccaatgttacactgagccagcagtcaacagcattgacgttgatcagtggacaacatgcgggaattccattactaccaagactccccccaaccaaaaatatccttgagcagcgttgtcttagccactttttcacctacactctcaatgaaattgatctgtcgcctggaattaacggattctggctcaaaacgctcccagcccttagtcaaaatgagccgctggttcggcatgccgttactgcgttgggagctacccactggctcttcctcagtgataactcctcaaggatcaatcatgaagctaaatatcaggcagttgttactcaacagttcacaaactccatctcacgattggtacctctcatgtctcaggccaaacccgagaatacaatcctggtcttgatatgctgcctgctctttgtattcatcgagtccctcaaaggctctcagaccgaagccttacgacatcttacagccggatgccgactcctcgcatctgttcgcgacctcccaccggaactagaagggaagctgcgcgaaatcgcaacagtattccggggactcgggtccgtcgtcaacatgtttaacgaagataagataataccggatctcgcgtcatatgcggaactaccaaaagggtacgaagatcccacgaagccctatgagagtctcgatgaggcagagcaagccctggctcatcttgatttgtttctctcggacatgcactgcacccacgacaactctgaaggaccgttccctgagcgactaaaagagatcaacgaggagacgtttcggagccttggaaggcgcttccgaaaatgggaagcccgtttcgagagaactctccaaagtctcaggccgcctcgtagctatgaacacctcaacttgaagcttcagaggtacctctgggctcaaatgatgaaacaaccatatggcgaagaaccggttattgatgaggagaaatgtatgtggttaatggataaagtggaggaattgctcgaaatgacgaacccaacgcaaagagtattcacagctaaggcggatttgatcccggtactagtcgtggtatacggatcttgtccggttatcaaagtacggaaacgggcgatagctctattacggttacgtagccgaagggaagggttctgggatagtgacgaggcagctgatttcctgcagctggatctcgataaatgcttggcaggtcagaaaggcacaagttggccggctgtcggtccttctactgcccagggggcacttctggttttcaggccgaaaccagaaacgtaatctataggcctttgggggaaatccggattctcggcatatggaactataactaaaaaaaaaaaaagagccaccgatgatgataaacaatgcaatgcggtcgtcatttccatcatactctgccctcctagacctttccctcgaattgaagataataggtatattgcgtctctataggtatatgcagagaaaacgttttggcgacagacatggcctccttgcctgctattatccctattccttggccgtcgtatacatgtacgaaagcgggagtacaatcgctgcgaggccaaccacccagggagcaagcttcttagctgctcgaaggtataccatgtgttctccttccttgtgtctcttctttctatcagccctatcattcagacgcgggaaaggtacatccgggatgtctttccccagaaacgcgcacagcggctcccatccgtcgccgatagagtactccaacctccgctcgggcggaaccatgtcccgaatctttttgaagtactgatcatacccgtgtcgtgcattcgcctcaatctcggacatgtttctggcgtcaaagagcccgtagctgactttcgtcaaagcgtgggcagatcttgatctcaagacatggctcacgagaaacagcatgacggtctgtccgactgtgaagagcttgtccaacacaacgactttgtagcttatccaccagctgtcaaaatcccgctgaacaatgacgactttggcattgggatatgcctcgatgagctgatcgacgaatgggcaggccatgtcggtgacgatgtcatatttggatccccagacctcgtcccagtcgttgcgagtgaaccttggccggggtctggcgcctgggatcgacggccaggttgcttctgcggcttgctcgatggactcccatgggtttccaaggatatcctcatcgccatggtgcgtcttgtagcccaggattctatacgcatgtgccatggatttcgttgccattcgaaacaaggagacgtgaatgacagccaggccatcgtccgaggctttttcgggcgggttcatggtgggaggagttacaattggggctctcgattccgcgtctgtgaaaaacctgtcgaggttgaaacacgtgaagccatgctggacagatcttgatggacatgggcatgggggaacgaagggtttatttttttccggggacgtgctgtttggttacaccgacccttgaatattgctcccttttttggtgaccatctaccgtcctccattgcttcccgattgcgacacgcgctgtgacatactgcggtgggacgcaaggagttcaatggcttatatgttacatagcaagctaaagcgcacgcagagcctgcaagtagtcgccgccagtatgtcgggagctatccaattacttggcgatggtgttgaggatgagattgatgccagatgcgcgccaagctccaggtcctaccggtccggattgctgcaattcctcgatgacgaaccattgatggctacagtgggcagcgcgtgaccggaacctgcgaaggcccctatttcggcctgcgggccctactccaggggctggcctccctgaggagcggcggtcgatccaccagactcagtgacaacggcgctgtttttttagtgctgttccattttccgtctgcactattcaccgagtcacagccaaatgtcaccgagtcaagcaacgaaaacaaactgcatggctgggcgggcgcacgcctccacgaaactatgcggcggtcagatctgcagaatttgcccctcgcttcgatctcggccatccattgaagagatggatgttatcgggtcgcttccggataagctccgttgctcggggccgccagagtagccgcgcacacacacgggcagctcaactagacagctcctcccggccatcacaccttcatagcagtccaatcaaactctacacttctttcctttcttcctttgttcattctctcctctgatatcagccttcgactgcgaccgcgtctagactgccatctcccacatcaacgcagccatgtctcgatcacgcacagttggtctcactggcagacgcctgcaacaggccttttcgcctggtcataaatatcagtggtcgcgatcagtcgcgtcgctctcatcagcagacaagacagtaggcatctctatgcagatgaaatatttggaagaaattattcgctaatattatttcaacagcttctgggcggctctctcctggagaatgaccccgagcttcatgcaattctcaagcgtgtaagtgcaaaccatcaggggcaatcaagtacagcgctgactcccagtacaggaagagaagaggcagcagcacttcatcaacctcattccctctgagaacttcacatccaagtctgtgctcgaggctctgggcagtgtcatgcagaacaagtactctgagggataccccggagccagatactacggaggtaacgagcacatcgacgaggccgagagactgtgccagaaacgtgctctggaagctttccgcctcgagtctgatcgatggggtgttaatgtccaaggtcagtttactctccgtatcaatactgagaggcataattgctaacacgcaagatagccctgtctggatcacccgccaacctctacgcctattcggctctcctcaacacccatgaacgcatcatgggtcttgatctcccccagggcggccatctgtcccacggctaccagctccctaccaagaagatctccatggtctccaagtactttgagaccttgccgtacgtcctagatgagaagactggcctcattgactacgagaagctgcgccagaatgctcttctctaccgccccaagatcatcatcgccggtacctcggcctactcgcgcctcatcgactacgcccgtatgcgcgccatcgcagatgaggtcggcgcctacctcctcgccgacatggcccacatctccggcctcgtcgctgccggcgtcctcccctctcccttcgagtacgccgacattgttaccaccaccacccacaagaccctgcgcggcccccgcggcgccatgatcttcttccgcaagggcgtccgctccgtcaagaagaacggcgacgaggtcaagtacgacctcgagggccccatcaacgcctccgtcttccccggccaccagggcggaccccacaaccacaccatcaccgccctggccaccgccctccgccaggccaagacgcccgagttcgccgagtaccagaagcaggtgctcgtcaactccaaggccttcgccgcccagctctccgacgccctgggctacacgctcgtctcgggcggcaccgacaaccacctcgtcctcgtggacctcaagcccaagggcgtcgacggcgcccgcgtcgagcgcgtgctcgagctctgcggcatcgcctgcaacaagaacacggtgcccggcgacaagtcggcactcaagcccggcggcctgcgcctgggcaccccggccatgacgacccgcggcttcaccaccaccgactttgagcgcgtcgccgacatcatccaccgcggcatcggcatcaccctcgccgtcgacaaggaggccaaggccgaggctcaggccaagggtgtcaagaaccccgccacggtcaaggctttcctgaaccatctcggcgacggcaagcaggttgaggagatccagactctgcggaaggaggttgaggagtgggttgggcagtttgaccagccctgggtcctgtaggggaatgatatcacacaagtttatgattttgtttatagccatattttgatcaatatttttttgtcttggagatggaaaaagaaaaacttaatttcagcgtttctgcctattttacttgaccttaccattgcccatcgacgataaattggtgaatatctatattgactctttttattagttgtattgccgcacgacacatgcatttccccagctgtgacctcgcctcccaaattgcattgaccttccctgtagttgctgaacgcaattgaccacgaatgcgtccgattaccggcctctgatgacagaaaaaaaggtgattagactcgagcttagcctaggttacggcgtgccgcgcagtcgagataacggaccgggggaaaagaccttttgcctgccatcgtcactgagtccagcttcactgagtcccttcactgagtccagaatccgctccggcccagcctcatgcatcagtggaaccacaaaatcaccgagtctgtggggagagacgcatcctccatccaagtgggtcggcccatcaccgagtcagagaaacaagcccattccagcccgccagcccgccggttttcgatccgagctcgagataaggaagctttccttagctggctcgagagcagtccaggtaccggtgcgattgtcgggggcagttaagctcgcctgcccagctgtttcctgccttactcccaattttcccttcctcagcagtttgccagtaataagcccgctatttgctatcactcgctctcttacacacgtcccaattccgcatacacatccttcactcacattcacaatggccactctcttcacacgccaggctgttgcctctgcctcgagaacggcgcgatgctggagaccggcagccgtcaaggttgctcccgtcagcagggccctgcccatctcacagcgcatgagcttctcgcaatcagtacaacgtaagatctagagagcttcgcttcgtcatgaacaatgaatactaaaaattaccgtgtcaggccttgagaagcgcttcaccgagactcacgaatggatcgacgtcgccagcgacggcaagacctgtgagtaccactcaccattgatcgatcccgaccaattgagctaactgaagcaccaaaaggcacaatcggcatcaccaagcacgccgctgaggccctcggcgacatcgtctacgtcgagctcccagaggtgggcgacgaggtgggcagcggcgacagcttcggctccgtcgagtcggtcaagtcggcctctgacatcgtctcccccatcgacggcagcgtcgtcgccgtcaacgaccccgtgtccgagacgcccgctgacctcggcaaggaccccgagggcgagcagtggctcatcaaggtcgaggcggccgacctggctcccgttgatgggctgatggacctggaggcgtacaccaagttcgccgaggaggatcactaggaattgtttactcaaaatattattattgaaagaattttattgtttataaagccgtcaagtctattgaaaaatatatcatttttataacatagtataaactccttcctctattcgccttgtgatatgttgaatcccaatgcatcgctatcgtagacctcgttgaatgaagactaccttgcaattctcaccattctgcagtccagtaaggtcttcacttctagaattaatcccaaatattttaaaaaaaaaacactgatcatgtaaccaaaaaatcaaatcgctctttctttctttctatctaaagtattactcggcaagctcctccacagacggacacgtacagtacaggttcgtgtcaccatacgcatcgtccacccgcgccaccgacggccacatcttcttggcccgcaggtacggcagcgggtacgccgcctcctcgcgcgtgtacggcctgtcccactcggccgcgagcaggtcctgctgcgggtgcggcgcgttcttgagcaggttgcccaccttgggcaccttcccggactcgacgtcggcgatctcgcggcggatctggatgagggcgtcgcagaagcggtcgagctcctcgcgggactcggactcggtgggctcgatcatgagggtgcccgagacggggaagctcatggtgggcgcgtggaagccgtagtcctggaggcgcttggccacgtcggcggcctcgacgcccgccgtgtccttgaaggggcggatgtcgaggatgaactcgtgcgcgcagcggccgttgtcgttggtgtagacgacgctgtagtgggggaggaggcgggacatgatgtagttggcgttgaggagggcgacgcccgtctggcgggtgagcccctggccgcccatcatgaggatgtaggcgtggctgatgggcaggatggacgcgctgccccagggggccgcgctgatgggcgcgatggcggtcgactcgcgcgccttgccgccgttctgggggtcggcctccgggtggccggggaggaagggggcgaggtggctgcggacgccgatgggacctactcccgggccgccgccgccgtgggggatgcagaaggtcttgtggaggttgaggtggcagacgtcggcgccgatgtctcccgggctgcagaggccgatctgggcgttcatgttggcgccgtccatgtagacctggccgccgtattcgtggacgatgcggcagacctccttgacctcgggctcgaagacgccaaaggtgctggggtacgtgaccatgacggcggcgatgtccttggcgtgcttctcgcacttggccttgaggtcggcgatgtcgaggttgcccgtcttggcgtcgcacttgatggcgacgaccttcatgccgaccatggcggcgctggcggggttggtgccgtgggcggagacggggatgaggcagatgtttcggttcgcctcgccgcggctctcgtggtaggccttgatggtgcggagaccggcgaactcaccctgggcgcccgagttgggctgcaggctgacctcgtcgaagccggtgatggtggacaggttcttctggagggaggcgagcatggcctggtagccgggagcctgctcaacaggggcgaaggggtggatgttggagaatccggggtgagagacggggagcatttcagtggtggcgttgagcttcatggtgcaggagccgagagggatcatggagtggacgagggagagatccttgtttccaaggtggtagatgtaccgtagaagcttagtctcagagtggtgctggttgaagacggggttctggaggaaggcagtcttgcgctggaggttggcggggatggacgagttggcatagagagcactgtccaggcccttctcaacagcggcattgaaatcctgctcagccacgttgaagcacttgagaagcttgcccaggctctccagagagacaccctcatgaagagagaagcccagctcggtctcgctgatcttgcggaggttgatgttgaggagagaggccttctcgtgtgcgttaatgacggcatccgaagatcccttgagggtcaaggtatcgaagagaacggagccatcgtctcggagaccggtagtagagcgcttgaagtcaccctggcgtgtgatgagatcctgggccagacgggtcttggcccaaacatcctgggcaatggccttgagaccctcggggccgtggtagatggcgtagaaggcgctcatgttggccagcagagcctgggcggtgcagatgttgctggtggccttctcacggcgaatgtgctgctcgcgagtctgcagagcaaggcgcagggccgggttgcccagtcgatccttggaaacaccgacgatacgtccaggaatcttgcgcttgtacttctcggagcaggcgaagaatccagcgtggggacctccgtatcccagaggaacaccaaatcgctgggagctgccgagggcaatgtcggcgccgaactcgccgggcgccttgagctgagtgagggccaggagatctgtggcgacgcaaacgagacccttgccctcgtggacgaggtcggagaggccttggtagtcgaagacaccaccacgggtatcgggatactggagaagaacaccaacgagactcttgccggccttcttcacgagttcgtactcgttggcgaggacgtcaccgacgacgagctcaatgccaaacccctccgctcgggacttgagaacctcgagagtctgggggtggcagttctcagaaacaacaaaggtcttgcctccgctcttgggggcgttggcaaaagccatagtcatggcctcggcggcggcagtggcctcatcaaggacggaggcgttggcgatctcgaggccggtcaggtcagcgaccatggtctggaagttgagcagggactcgagacggccctgactgatctcggcttggtagggagtgtagctggtgtaccacgctgggttctcgaggatgttgcgctggatgacggcggggacctgggtaccgtagtagccagctccaatgtaggtctcggcgaccgtgttcaggtcgccaagcttcttcatctgctccctcacgaactgctccgagcgcccgtttgcaggcacaggagtaagggggtcctcggccttccactgctccaccaaatccaggccagtggatttcctccggacctgctctgggatggtctggctgatgaactcctccatggaggcggcagggggtacgagggccttgagcatctcctggtgctcatctgcctcgtcgccgagatgccttcgggggaaggactcatgttgttgaagcttggcaaaggcctctgtttcggtgaagctctttacctggcccaggcggtatgcctgtgtggcgaacccggtgcgaagacgggggctctggtgggcagcatagcacagaacatcccgagaggcaatgcgaggagccttcccgggaagtcgctgcaacagctgtcgtcgagcggtgctggacagcattgtgacttgggacgagatgtcctgtggggtggttctcttggggtgatgacaggtgaagaagtcaagtgaaaaagctcacaagacaagggctgctatctttcccacccttgaaaagatagatgacgcgatggaagactacaagtcagacaatgatgtgttctggaaagaaactttgggttgagggatggatgatgggtagatgataagcgccatgcaagtgcactgcaggctgcttgttatctcgccccctgttctgtaacactacagcaagggaccctcataattttttccatccggtcgcttcgacatcggcacaggctagaaaattgccttgggaaaggctattggccgatccttgccggcaatccccggccgtgcctcatatcggcgtggctccgtggtggggcgatgactcggtgaaatcctcctcttgactcggtgctgagccgctacgcaccgcgttcgatcaatctcgaggccattgtcgggagctggggatccggggagaccaggggacgacacacacctctcgtttgagatggagggcgacgagattgcgttgtgcctccattgactgtatcacagcgcgtcccgcgcagcatcaccatgcccctttcggtgatttttacgcaacgatatctcactcggcgtcgtctcgtgatcgatgagagaatgtatcgagttagcgtagtcgccctgttgattgtgtaattgcaacatgcaaatataataaataccgtccaggagtaaagctcggacggtcttccggcttacaagtagactggaagtaagagctgttcaagcttggaaccaacacctaaagtttccttccatctgtcttaccttctaaattttacaaagccacgttcacttcaccccaatatgacaatctcccgccgtcaaccatgggtcgcgactcctctgattgagtctccccagctctcaaagagtgcaggatggtatgtgtccccaggatctggccaccagtgatataaaactattttgggggttcacgatgtgaagatacatgttctaaatcgtagaagtagaatctttctcaagctagacaacctccaaccctccggctctttcaagtcccgaggcatcggcaactacctcctcagtcgcatccgagagcatgatgtcactgatgggaagaagccgcacttctacgcctcgtccggaggcaacgccggcatagcatgtgtcgttgcagcccagtcccttgggtacgaggcctccgtcgtgatacccactacggccagcccggctctgattgccaggctggaagaggagggtgccagcagcatcatccagcacgggcacagtgtcatggacgcggaccggtacctcaagtccacgatcctgcccgctgatccaaacggcgtatatgtgccgccctttgatcaccctgacatctgggccggcaatgccaccgtgatgcaagagattgccgcgcagctgagcgacgagcagcccgacatcgtggtctgcagcgtcggcggcggcggactcatgaatggcgtcgtgcagagtcttgaccagctcggctggagcgagggcaccacggtgctggctatggaaacggccggcgccgactctctcaaccaggccctcgaggcgcggcagctggtgaccttggagaagatcacgtcgcaggcgcgcagcctcggtgtcgcgacagtgtcgcagaagacttttgactacgcccagcgtgatcaagtggtcagcggcgtcttgagcgatgccgaggcggccaagggctgctggatgctggccaagtatgagcgcctcctggttgagctcacggccggcattgcggtcaggctctgcgaggacaatctcttggagaagtttactggtaagacactggacagggactccaaggttgtgctgctggtctgtggtggcaacgacatctcagtcgagatgctcatgagatggaaagaacagtacggatactaagtgatgggtttattgaatgtttttagttacaatatttacgactaaggcgagcgtagctactgaatgcaattggtattcaatggattgggtctgctggttccaactttccgtgactttacaaactcaatgtaaggcagcatgccatctcgacataaagtgaagtcatgcacgatctctcttctgagcctctacgtaccaacagatggtcaatctacactccacactttcctgcacccttatgtccatgccaaaaccacgaagacgctcacaaatcaccgtggttggtattttatggagcctccgagaaacggcggccgggattcggagaagctgttcgcaacaaacgatcaatgaaatgaaaattaggacaatgcaatgtacttcgtatctctgcctgacgggcggctagacgcctccccctggtccgtccgacgggcgcagtcgtagcggtggccacagttgcatcaaacatcattggtgatgatgactcggtgatgtgactcggtgacagcgaatctcgaccaccaacaaagaaggcgactagcattgaaattattgcctgataagctcccgtatacattccggcacggctggtcgcattgcatattaccccgtatccaggcaccgactaccatccgaccgctctctgccatcagtcaacattgttcatgaacaacagctggtctaagcatcggcattccatcttcccccaacctcatcccttgtagatgcctctcttccacggcttttatcatattattacctttattactttactttcagacccgggcggcaatcagtaacgatttgcctgtcttcaccacccggcttacacgcctccaacttatcctctccctcaccttcaccaccaacacacacatcatggcattctctgcagtgtccaggccgcttttccgctcgcgattagcattcagccggtgcctggcctcctcctcctcccgctccatctcacatcccgcccccatcacctcctcgcggcgacactactccgccgccgccgcctcagaggagctcaagaagactcctctgtacgacttccacatcgcgaaccagggcaagctcgtcccgttcgccggataccacctccccatccagtacggatccctctcccacaaggaatcccaccacttcacccgcaccaatgcgtccctcttcgacgtcagccacatggtccagcacatcttcaaggggcccgacgccgccgccttcctcgagaccgtcaccccctcggactggcgcggccagggctccatgcagagcaagctgaccaccttcctctggcgcgagacgggcggcatcgtcgacgactccgtcgtcacccgcctcggcgagcaagagtactacgtcgtcaccaatggcgcctgcctcgacaaggacctcaagtactttgacgaggagctcggcaagttcggcggctccgtcgagtggaccaccctcgacaactccgggctcctcgccctccagggcccccgcagcgccgaggtcctccaggaggtcatcgccccctcctccgccgtcgacctgtccaagctgtactttggcaacgccgtctgggcaaaactgaagctctccggcggcgaggaatcccaccccgtcctcatcagccgcggcggctacacgggcgaggacggcttcgagctctccttcaacgggaaagcctacccggccttcgagagcacccccctcgccacgcagcacctcctacagaacgccggtcccgagcgcctccagctcgccggcctcgccgcgcgcgactccctccgcctcgaggctggaatgtgcctgtacggccacgacctcgacgacaccaccacccccgtcgaggccggcctgagctggatcatccccaaggagcgccgcgcctccggcgggttccacggcgccgaggtcatcaacgcccagctgaccccaaagagcaagggtggcaggagcgtcgaccgccgccgcgtgggcttcgtcatcaacggtgcgcccgcgcgtgagggcgccgagatccacaaggacggcgagaaggtcggcaccgtcacgagcgggctgcccagcccgacggtgggcaagaacatcgccatgggctacgtcaaggatgggctacacaaggccggcaccgaggtggacgtcgtcgtgcgggggaagaagaggagcgctacggtgaccaagatgccgttcacgcccgccaagtactacaagggcgatgcatagaaggggggttgtagtagatatatcacgaagttactttttcatgggcttgcgcgggtttggttttctttcatccaagttttgtttgtctttttgtttctttaccagagtgctgagtttcatatgaaacccaagggtggtaaaccagaattccacaataacgctaaaccgacaatgcctcccgggatcttgttgagaaagatcagtaggggttagaaaaaaaacacgaagaaaatactgaattcaaaacgccgagctgtctccggtggaacgttgagccaccgtacttcagtgacagccctttaaaacttcccttgctgtaaaagcatccagatttatggggacgtgacggaaagacaccccagcccttgcttttagaaagggtagtggtgatagtggtggtgatgatggtggtggtggtagtgatggtggtggtgatggtgatggtgaagatggacggagggagtcgacgaagatggtaggtttgtccggcgctctacttcaagctctgctgcgcgagactgggaagactctaggatgtctcgaggatctcccggggccgcttgctgatcaggtccaagctcctcttcagcagcctgttcggtggccctcagctgtgactggatcgctgcatcgtcgacgaggggctgtgctgcgtcatggaagtgaggtgacatccttgtcgagaccggtcccacatgtgccgcagctcccatggcttgctctgggtggcttgatgcatttatggaatgcgtatgggtgtgcatctgagatccggggtggtgcaggtgaacttcactgggccgtgcctggatgccgatgccggcggcattccctaccgaacttacaggaattaatgacgaattcaggttgcccggaccaggtcccagatctggaggatgcccatgcgatgagacatgacccatatgactactgaagaggttcgggtccgtgggcacatctaggccatttaccacgagcggatcaaaatgttcaaaccccaaacctacagagtcttggaagtccattgcaccggcaacgtcgagatcggtgggaacggtcggcgattctggggattcgatgggttcgttctccgagatgagcggctcgtttgattgttcaagttggttgtccgaagcgcctggactgctctgctgcttggacaggttgcgccaccggttgcgacaggtgagcggcgggcgccctggaagtcgagcagagatggccgcccatcgatgacccagactgcgcacgccttctctcagaatgttatcctcttcgggcgtccagctcgtcagcctcctctgtgccaggggatctagaatatcgttgtatcgcttggagcattggtcgtcctttcgcccggggatgagggacgcgatctcgtgccatgatgggcctagccgtgcgtaggcttcgagtagaattcgatcctcgtcttgcgtccatcgtccttttcgtagagaggggtctagagagtgaaaccaccgcttgcgacaatcctatcagacatcaattggttagacggtggaatggaagggatgacatgtgtgcaggctggggggctacggcataatcgcgcatcaagagatcaatcccaccttggccgtacgaccaggaatcccacaggcaatctctttccatcgtccgttggcccctctcgcatccccatagtgggcaacgcgagaccgtagggtctgatcctcccaggatgtccaacttcgccgtgttcgtcgagccgagctggtggggcccgtgtgcgttgcggtcgacggctccagctgggaggatacggtcggcattgacgagaagagatccccgagtgcgtgagttcccgtccgtctataagttgaattgagcacacatgaacgtaaggccgctggccgaacaagacaatctgaaaccctggctggatgatgacttgcggtcacatggttcgctggttggtgtggatgtgtgggatcctgggcggtctgggaaggcagaatgggggggtcgtgatgataagagataaggctcctgaagtcaacctcaccggctttagcacagggcaccagcgatcatccaagcatccagaaggccataattgatcatagcaaccgtacacagcatctcaaaatattcaaagcatcgccgtacaagacatcaattgccggagctagagcattgaaagtgaagcttacgttgaggggtcatatggagcccggacatgatcgccgtcaacataacaaatcatgtgcctcggctgacctccgattcaagcatcaagcatcaagcataaacaaacgtctgaaatcgccctctgggcaccctagccctatataaatatattacagaggtgggcaagagtgatgagaagccgtgagcccacctcgtaccaacaactttctgccttggttctcgggcttctctcgggccttcggcgttcggtgtgctgtccgtccgcgacgcacagctccggctccgtgattctcagcccgtccataagtaaggcaaatctcagacagacggcacggcgaacgccggtcgccgacatgtggacaagagttaccagacaaccccttaagtacgtcgaggaggaaccatcaatgagtgtttgaataagtggctaccctataccccgaccctcgatgaacctccctcctccttgtttaggaacaaacagaagatccaaggcggaaagatcgtaactattctgagtttcattccaaataagtgttggtaaattgagggtgtgattttagaaatattgattgatccatatttcgaaatagttgtcgccccaattatcggaataacctcaaccaatatgtctcaatgaaaaacacgaccacccaccgtctcggcatgccctaagatacttgcctgaaatacagaaaagcattaagctgatgagctacaaaatcgatcttggcggtcgtagctgcgcacatgccatactttaattctgctgcggcgtcggccatttcttaggaatcaataattcggaccaaaatgcccaataatgactcagatttggtggtgttcgatcgggcgcgggaggtagcccgtgatagattccacttggcccactgcacttatacgcacatcgcggggctagatcgtgaatagacaggggcggacgtggactccggcttgatcttgtaccacgtaccaccacgatgacacataaatctcggggacaagccatctagaccgctcccgactcgtacatggccgaactgatggctaagacagatcagtagttcaccgtctgtagtgtcagttagcgtcttacgcttcggcttcttggcaggggccatggcgtcccgcgagggtctgagctttggcataaactcctccagcatgtcgaaattcgctgaataggatcttttccctcacagatgttggcctcagttttcttcttggagtgggcttttatgggcggatagtatgctatccctccaaagcctaaacatcaaccactgatcagtttaccccttttcataaagtagagcgagcgacgtgaatcgcaatgacattttcggctgcctctagtactcttggtactgcagaatctcacccaagagtggagtctttacgacactctgaaatagctagttctacagaaccacatctagtctcaggagctcgattcactttgatgtttgaggtgttcctggggcggctaggcgtatgactcgcgagtttggaccccagttttgccagcaaagcaatctaattacggaatgaagttgcaggattgtgggtttatatttctattgtacctccctgtctgccgtcgctgtgctgtgcagttcatttattcattaattttccgagatgtttccaacttgtagctaagggggagtgtttcatttccattccgcgacacttctgtgtaacacgagacatctatcacagaccacataccgcatcgcacataagagaaggaccgccaagatgtatgtgctgggagaggtcgacgaaacggtacgactagcatcgattccgactcgcaaaggctcgatcggtgaagccaacgaatgggaccggcactaacttttcacacagtttctccaggaagtatggattctgtatggtatcggtaccctgatcttggtgcttcgtcatgtcatccgcgcccgcagtgttggtttcaagggtcttcagggtgatgattacttcgccatgcttgtcctggctctctacactattgacgcagtcaccgtacataatgtttgtaagtatatgtccaatacttcaacgacgccgaatttcctttggctgactccggtgaagactacatggcaacaaatgtcgagggatcagtgatccagacacaacgaggtaagactcctcttctcgctccggtatgagcagctagaatcactccgagtactaaagcagtcgaacttatagttcttaccgaaggggagatatcgcagcttgctgaaggctcgaaacaagagctcgttgcatggtactcttatgccacgctcgtgtggtgtctcaagggcaccatggtttgcttcttcatgcgcatgacaatgggactctcgcagcagcgactggtaaactacattggaattgcttgcattgtttcatatgtggctgtctttttaaccgtatgaatttcccgccatggtgcaagtcgagtaactcaagctgacgtgacgcagatcaccttcggatgcttccctgtccacttgaactggcagtaagtcaatgtagtattttcactggatgtgaattaacactgacctcattcaatagggtggttccggatcctgggcgtatgttatttctttcattgccgacgatgcttctgacccactaacaaaaattaggaaaatgcactctgaagacacagaacttctttgtcatgacagttctgaatgtgatgtaagtattctagacatgcgtcttatacatacagatgagaaaaggctaatgaatgtttagaaccgacgctgctatcttatacgtgccgttacctctgctatggaccttgcgtgtgcccattcgacagtacgtccaaatcccgcgaatttataactgaaagctaacatgccgcgaaggaaattcgtgattggaatacttctgtcctccggtatcttcgttatcgccgcagcccttatccgaatcgtttccaccctgtctgtcaacccttcagccctcaccgtcaatcgttggggtgtcagagagactctggttggcatcatcgccgtcaacgtcccgatccttcgaccgctcttcagcaagaacttctggctcaatggtgccaggaccggaagtggaacaggaccatctaccaccggactgagcgttggggcgcagggcccctacgaaatggcacctagtgttaacggagaagacagcgcctccaagccgaacggaagcgaagagaatatcatcacaaaagacgcccgggtcactgttaaacccaagaagaagatgtcagagggcaacaacgtgttcgtccacaagacatatcaagttacgaatgaagcgaacgacggaccgaattggcagacggggacattctccgagtccaaggccacaaagcgtggcgacagcaatgtatagtaatagatggtggtgatgctggtatgatatgaagtatacgttcgatggcacagatttttagatcatggctcagtagtaagagccgatagtagatggttaacattattataaaatgaaagtctatgtattaatcatcaactttgcgccttctactgtagcagagttaagctagactaggtattcgccaatctcgcccaagcactttatgccccaagctgtagtccgccaatatagcaaagagctgaaaagatagattccgttcatatttttgaatttaatcaatttaaaaatatttaaagctccgggttgaaattgttctctgagagccctcgtatgcctgccttggagggtggttagttcagcgtagtgcgcttttcaggtggtttcaccgaagcttttatcaaggttggttttattatcattcctcaaccctttcccttcgttcaacactcaatttaaagcttcttacaacgcataaactaactggtggtaatctcctgctccactgctggagatcacactacttctcccccgctcctaaccgtgattttcacgcaagaaagagaagcaaactccatgcttattaatttagttaaatttggcttttcttaaaggttttatttgctactgttatcaatggcgaggatctggtccgtaagctttagcatggcgagcaactgacttattctacctagtcttcaactagtaacttctgcatgaaacctagcaccaaccagtttccaattactggtgataatattaatatgaatccatcttgtgtattgtaccgtggctgattgatcttggaacttgggcactagtaaaaagcttcagcaggaaaaacaaaaacaaaagcgaggcattacctcctgtgtcaatagattcatagacggtaatccacgcccatcagctctgaaggcgttctgacaaaggcgaagataatacagtactcgaaccacgccacccttgactcatgtcattgcatgttgaccgtcccgtttgagatgggacaaattcaagagccacaaactctggatgactgcccgtctttctagttcttttgtctctcatatgctcgactatggtatattgacatctaggttttgtaacatggtatcgcggaccctagcaagtatggcatctaccattgacctgcagtaaaaggcttcgttgtaggatgcgctcaaccacatttgaccccgccacgtgtgcagcatcatgacaacagagtcatccaaagttcctacggcgatccagattttctcgactttaacaacctcctcctgatgtagatactcatgttttaggtacttgtcgacaatgccgtagctggccgtgactatagactttagctcagggtgttcctgcagcatacatgagagcagctgggttgccgatgacaaggcggcccctttttctggaagaatgccatctccatggtaggtgtccatcgctctctttgcattttctctgaagggagcatttgcataaagtttgattggcgttaaagcgaagcggctgcagaccagaacctcgtcatcaggcgatggttggtcagtcctccaagatcgcgaatcaagcgtggtcatcccagccaaagccatcttatccgataatggacctatgcaagtctctgtggcaacgtcggccaatgtggatgttatggctgccaaccaagcggctgtgacggtgatgctatgctgacggcaagctctgaccagttgagtactggcttcttgcccaatggagaccgctgagcgcaccgtccgtagaggtgtcggcttgttgtgcttgctattcgttggtatagctaatggatcgacgtcgctcaaaatagagagccagtcgcgagcgacaaggctgtccttccctgactgcgggtatgacacaggtatcatgtcgtcaatttgtaagggcagttgctgtatgcggagccgttcagattcgttttctgtgaggtcttcgttgacaagagtactgagatacttgtcaaagagtcgatatatctcgcgcgcgccgaaatgaacgtggccggcctggatggcgaggcagaatcttccaacctcgccaccaggtagaaaatgcaacgtaatatactttcgacgaagtgattccgccaagatggactccatcgttgtcgactcttgatgcttgataaaagactcttctgcccatgcattaatgtccgctttgcacatttgggataatacttttttcccatcgcaaacaacagctgtgagtgctggagcgcttcctcgtaatatgcgccacgctcgcctcaatcggtcttccaagcctccacgagaaggcatgaactgaagtcgcaggaaaccatgtacactcaagtgctgtcttggtccaggcattgatttatctgtctggtccataaattcttcaatgcagccgagcttttgctcgtagacattgtcagtcattttccatgggaagtgatgcatggctgcagaccgtcggggcgatgccaagtatagtagtgtgagaatggcataagaaatgagcgaccggggagcacaggtgggcgtgggctaaacttgcccccttatatgttcggcagactatgtataagactcagggctataaagaaaattaaattttgtgtttatgcttgatcctgatttgtttgggtcgccttgtgaacagccggcggttattaaagaactatggaggcatgtacattccagtgatcgggttggattggtatgtgatactcagtatgattcctgagtcaaaataggataaaatttcgcctcctccagacctttttacattatatattatatttgaacgccttatgaagtagcaattcagctctattgagctactctaactacctacacttcataagtatgtcctataatagaaccccactcgtgttaatcggctactactctgagtcttgctatcggaagctcattcaagcccagactaaagctctgatgactgtttacgacagtaggtcgccactgaatactagtatactaagtgtattcgtagatgagcctttcactattaggtgggcgttgatcgccttgatggatgccttcagcagggtctttctggtaggcgacaacacaacaggaagtggggcaaattaagattggcagatgtccaaatttggcggtttagcggatgccctgctggtctggtagatgccctgctggcttggcgggtctatggcagatgcaatgatgtagcggatgctcttgtgggttggtagagctctgtttaagcatccttggtacgttctccgttcttgatttacaggtgcactagtatttcgatgccctatcagtttcagtgcgtaccatacctcgttgcggattcaatattggactctctatacgaagctccgtggcgtacgttacgaggcagtcgttaaatggctattgcgtctattgtagtaaaaagacttgagcatcttattctagcgtatagtagattttgtggtagtaacaagtgtttatgtgttagcctctggtgcctctgggtcatgtgtggccgcctttttagctacccgtcaacggcttgttacaaaacacgccgaaacgtgctgggatatggcggaactaaacctcccagtcttctcacggaggccataaagtgtctgaacaatctcaggatatattgactggagggggctctgagccttcatatcgcctagatggcggcttggtatcagagaagatgacatctgcctagcccctgctgtgcggaaatgtacaccataggtttggcagcaaggacgacggcttaacaaaccatcagtccgggtttgtgctatccccaagaggatggcctagaggcttgggacgtcgtagtgacgcaactctttgtcctgtttttgatacgcgaagacggcgcgcggtctgaggagcgcgcggtccttcgtcaaccggccacatgcaggtgtgtgccgaccacgccattgctctgcggagctgcacgccggcgtccgtcggattgcagaggactgtgactacggtgtgccgggtcttgctacggctacaagtcggtctagttgcgcaggttggctatcttttactacacgtcgagcgggctagccacaacagagcgcctcatagggagttaagcactgtgacgtggagcgcattgcgtgttgacctgtttatcggcattgttgcacaagcacgcacagtgaaaataggtttgtggataggatgggcagtatttataacccacttaagtcttaaaccatgcgtgactgcagatacagggggcaaataatgcaacacgccctactcaaatgtagagctgtattcataatatatctggccaaggaaacaccaccttccccctgggacatcccgagaagaaacacgaccctggcatccactgcttgaaatacagtcgaggcaacgagtcggtgaggcctgctagttccacttgaatagagacatgccggtgcaagtcattgtagttccttagcttgccatccacggacttgggacgtaaaactgtgaaagcgtaatccgatgggccgaacggttgcggatgctcatcatgattatagataaacagggcagaactttgaggggtttcattggtaggagagccgtacaaacgccccaatctagggactttgccatctttcattgcagcgatcacttcctgaatcattgttgatacccagcggcgtgagaaattggatcttgtaagcggtctaagaggcgagttccagtcattgttacggatgaaatggtcgatcttttctgcgagtaatttggcaccgttgtcccttagaatattcctcagctgctttagacggtctctcgtgactaatgtcggttccgaaggcttcaaacgcagtggatcagggagcaactcgtccgtacgtatcagcttctctagcttcttccacaaatgcccggtggttttgacccctgcacttgtaaggtaaacagaatcgaatcggcaatgcttgttgtacgtgagtctatgatgttttgggggagcctcaaattgcggaaagaaaaagcgttccgtcgtgggtttcggccgcggccgttgttgaaaacctctccgttgagaagacgcaaaagcaaggatattgacggaaagatcttctttgtcaagcgacttcacatccagccgcacaggatatgtgcaacagtttgcgataatggcgaggatatcagactccacggtcacctccttgaattggaggtcggcgataattctggacgtcatcgattctgatttatgcaagagaatcgagtagctcccagccgcatgaaaaatgcgatgtaccatgtcactctccagtcccgcagcaagggctgcttggcaaagcagggccgtgtgcttaaagaagctcgttgactggatgctcaattcgccagggacgtacccgaacacgtctgcaaactccctcttagtactttccaaatttggcggatgatggattagcaatgtcatttttgtgccactatggtagttctcctggaacgtctaagctctcgtctactacttgttactagtaatatgaaaggcatgatacgatcaagcgctagaagtgcacaagaagttactgacgctcttaaatgatcggtcactaaagtgttaactgttttgtattcaccaagatggaaaaacatcaagtgatggctaaatgatgtcgatgcctggccattactacttatctagctcttttatctccaccctatgaaatttcgcttacactaccacagcctatctagatacgagccagctcatcatcttcatcctcaaatatggtaagttcttcactaatcagccctgggagaagattggtctcatctcctgcccaacgcatcggggccaaacaaaacttggcctcgcgctctatgctctcaaccccacactgtgtcaattcggtgagtcgctggacccagaagccccaacgctgcggactatacccagtgggagaggagtcagtggtggtaccagcttgaagtgctaggtcaccgaggttagacaagtgcgggtagttggcagcattagtctttatcatgctcatagtagctgctgatgtttggctactactcaagatagcaaggccatatccagagttttggcataattctgtgagatgttctagcagatcctccagtgataagagtgtctcaggggtttccttgctatctgcatctgtaacaagcggccgcgaagtctccaaggtctcccggaataatgataatgcacataaaccagggccatcataaaaaccagcagccaagagccgtgcaattaggcctgccatatttcctcgctgctctgtactatagtctttctgatagtaatattttgtaaactcttcagtaagacatatagagagaaggggtagaccagaccaaagtgtatggccatcagagaaggtgatgaccccctgtacagtactagtacccttgttggaattatcatccaagttgctggtctgtactgaacgttgcagggtcccaagagctctgaaagtaacaagttcacgtacaatatcatcttggcgacacccttgtgaaataccatctttaagaagctcgtctgtagtaatattcttgcctgcttgaataagagtataccaaatatcacggagttcagatgcataaaactcctccggtcggctgttgagtgtgtactgtatattgattgttttaaggtgagagctgatggtgccacacagggtatcttgtcggccctgttgaatgatctcgtcgatttgggccttgcgaaagaccgaccatgctttagaagaatccatccttggatttaagagtaaaggagacgtatgtttgaaaatggtaaaggtgagatatgagtatggacacctgaaatgcttggttgcatatccaggaactgtttgtcgctggaggcgaccatcttaagttgtgccaaaggacggacctctttccaacaggcagacaactgcactgtccctgcatctccgttgctttgcatagtctgttggtggcggatactagcataccggtggctgtgtactcctgttggtggggacgggcaagtatgactgcatattgttgttggcgggaaccaagtacacctaactttaacgctatcccctgcgtactgttgttggcggggaccgaggttatgtatgactgcatactgctgttggtaatactcatgataatacgtccaactagtgtgattgttatgaatcacgcgataggagaaaatatcgttcccgcgccttgtttcggcggcattatctgtacaaacacacctttattactagtaagaaatattcgttataccatgtggctacgctgtgattgaatgatgagcggttcgcttagccctgtctggaacatctccaccatgttttctcatgcaataagagtaataattgagagcacttgtagagttgtatgtcgagctgaaaaggatgtcatagtttgaccgcatatggcaaaaactgtctgtcagctcgtttcctcgccacgctctcgaccaacagcatccggtggccctacgtggctatttttgctgggcctcattttggcggctccgagccaacaactgtgtaagccttcctccttcagctttggatcataaagtcctttcagatacagtagccaagttgttgcatatcattgttgaggcgatttataatcgcgccaatgtcgcccgcctcccatcgtgctcggggcgtggactttgataacgacagctcattagaaggggaccgacacacgcttcgtcatgccatacatgagtcaagaaaaaagagaatggcatgggcatcgtgggaaaagagagaacgtaccgagaaggtggagatattcgaaacccttgtccagcaacttcacaatctggtgcccccctagtacggggaacgatccatggccagcactgaaaccagacgttcgtagtaccaatgtactcactaaaggtaaggtctgcatcgcgccacggaaggcgacgtctaactagagctaggggttcatccagtccacggatggtctattgagatacgtaggaccttgaagcgaattgaagagaatgccagaggtagcatggtcccatgccagggccttcaagcctggtttctcgtgctaatatcatgtagccgaaacacgacgccaaattcgcgcctggctcagtagttaatgaatctccggttactcaaatgcaaaaggggcaagtcatcccccaaacgagtaatggtttagacaatgctatatgaggaaggctaccccgaactggcgcggctttccttcgctccgatgatcgaacacctcctagcctagatctcaagaggagatttaaaaaaaggaagaacacgcatttgcttatctttatatctacgaaatatacctgttgatgagtcacgcgaggggctaaaattatcagaatcccccgaccggaatgcctcccgaggcttgataaactggttattcccacatcatccaatgccagcataatcccctcaccctaccccgcccaacgataacaaaaatgcccagctttcttgtacttgataacaacactatcacagatatcttcctcagtttatctaaggacgatattctcaagttcaaacatgcgtttgagacaacgatcagggaatttatcctaggcgcggagggttccttgcagcctcagccaaatacggtcgttcgtccagaaggggggaagacactcttcaggccgtttactggacctaaaagtgttggagtcaaaatcgtgaccacacctcctccaaggcccggcgaaaagctccctctcggaggtatcatcactctctccgacgaaaacggtgtgccgtcggctatcttcaatgcagccgaaatcactggcttccgaacctctctcagcgccttgattccctggtattggaggaagcacacagaacatatagttgttcttggtgccgggaagcaggccctttggcatacccgtcttgcgctggctctgaggggtgacgagatcaaatctatcacaatttataaccgctcccaagatcgtgcacaagaattattgcaaaccgtgcaagcggataatgataagtattggaagtctgccgcaaagttggctgtatttgattcatccttggccgactccgatgaaaagttccgattgctgctcacagaggcagatgcgatcttctgtactcttccgaccactacaccactattcaaggtagacactattttctacaaggagcgaaagagactcccttatatttcagctattggttcctggacccctgatatgactgagatcggccccgatgttttgcgcaaagctgttgagacagagcctagtttcaacccgactggtggaaagggtagcgttgtgctctcggatgatgttcatgaagctactctcaaagctggagagttagtgaatagcgatcttactacggatgaattgctcaacgtagggcaggtgatcgattggctgcgaggtaatggggatctggatgagtcgcagagggaacgtcttaataagtggctggccgagggcttcgtcgtgctcaagggtattggtatcagcaccactgatttgacatctgctgaggagattcttcgagtagctaaggagagaggccttggaactcctatttcttccttttaggtagtagatgaaaactagtgtgacgtttctcccgatgatgagagttatcttctcaaaccccgaacccatttcactgagtttctgcatgttgccatagcctagccttaaatgggcttcaaacatcactttgttgctccgaaggatatctaagcacgagtgccaatttcgattatcgacatccgcatgctctgtatattctagcaatatgtggcatttacagtcgatctcaaataaaagaagaatccaattccatgaaaacactgtcccaatcaaaagatttaggatcaatttcaacgccttcttcaaagttatgagtgaaatcagtccagtatgatgaaatatcttctggggtaaagttaagatgttctccagaccttgcgatggggtttgggccattgttgacattaaaaggatcctcggtggtttccaggaaacgaagattatcatagatatcatatccaggaggtatagtattgtcaaagggcgtttcttcatagggatgtatttgaggatcacgttcacccttgctaccattgtatgcaaaaggttcttgctgtttgcttggaacacaatcggaagctgacgtctggttttttcgaagaatatgtatcagcgagtcaacaaaattggaagtggtttctgagccctgtttcgcaatttccatgattttgaaagacctaaagatctcctctcgcttctcatggtgttgcggagacagcgggctgacaaacgcgtccatgagcagaacggcacaagccaaaaagacaccaaccaagagctcggtcagtttattctgtaccacattgtcgatgtcggcattctccgaccatatatttgatcggatgagcaatcgcgcgtgcttgagacagatttcccgagaagagtaatacgctgaatcctcggcgctacgtataaaatatggcaggtgaatcttgcatcgttgtgagtagagcaagaagtaaacgacttttccttgaaacgcgatatccgcagctcgagtctgagtcaaaccgtaggtctccatcaacataggcgctgtcattgaataaaaccctggaacctcgttgataagactttggagttccgtatcgatgtccataaccgcatcatgacttaggcctcctgtatgtgccatcatgagcggacttcgatcgacaatgttacgagatagttcagctaggcgtatcctctgcaatgtatatgacatagaggttagaagcgaaaggggtcgttcatgacgactcataccatccaaaacctcttcgtcattgatgttgagtggctttttcgtgatcatctggcgaggatggcatgaataaataccctcgccgactccgcctactcgtgccgccatagcccttgaagatatgttagcaccctagctttggcagattagataacatgagaattaccaatcagatgcacacaaataccaccataccctgcgttcaatctctgcctgggatgtgttcgcctttccagagttatgtggatggtcgatgcgatgaagccctaagtcccgagcgagtaccaatgcgttggcaaacaggacccggtatctatgtaatccgtcgatatgggcagccataaatcctacaagtatcattccttggacgccttcaatggagattttccgtctccgagaggtggcttcgagaacatcttcagccgcgttgatccacagagatacttgttcgttagcttctgacggggaagaaaatacaccattgacgccatcgcttggggcccaggaatgagttgccgccgcgataatgcttaggatcagaatgacatgtcccggttgtacctcctgttgtaggctcaaattcgcatagactcgtccaagaatagagggaagatggggaatatgggtgacatgtggaaagtaatgagcaacccgaatgaacttttccagaagtattttggcctcttcaagttggggtaaccatatgcatctcgatagcccagagctaagagttgggcttgattcaggctggtgcacgtatttttgtgccttggctatctgttgagccgggcagattctgataactatgtgatttcttagtatcacggtctgaataacagtcagtggaaggttctacattgcgatccactccgtgagagagtgagggaattcaaagcacgacctaggagctgcctaagatgaacaacaaacttactgaatgaatctttccagtgtaagtattctcaaggtgggtcacatcactacccatatctacatcctggaattgtgaagacgaagttgattgataatgagactctgaactctccggacactgggcgtttgttcctggtacctcctctttctgggcgagcaacaagctctcaagcctgtgaaggcgctcaataatctctgaatttccagaggattcaggaactataacaggtggcgggtgcggaggttccaaatcgcaagtgataccccttgaaatgcagttggagcaaggcgctgttctgctacatcgtagctttcttgtcctacaaaaagtgcaggacactggtttctggcgaaattttggcggctgagattgctctttgggcattctatatttttcaagtttttgttgaacacttgggaaaatatgagattctcaaatgttcagcaatcgtgccggttgatggagagcgacaaaaccatcggagtttccgtcaaaatccgcggaatttaatctggtgatgatgacataagccaccaccacatccctacataccaggaactagttaagattcattgcttcagctggggtgtctaatgatcaatttggactatccttgacctgtctatgtgatgaagttgatacaagatctgaatggaacaaaagacgaccaaaaccttgtccctctgccttataaatcaaattgaagccagccgtctacaatccctaaatatgatcggcatctattcttactttaaaacagactgctaacagagcttgcattgagcagatgacacccacagacacttcagtcagtcagttagtatgtggtgcggttataaaacacaaggtgggaagataggagcccaggcaagttggaagattttcctggaagaccaactgcactacaagcgacgtttagagatgccgctggttcggatgctctccccaaacttccagaagactagaggagttggagcaaaagccaccgcaatgaaacccagaagcgatgtgccccatccgactccaagagcgtcgtacatgctgttccctgccaatggaagcagtgcgcccaggagagagcgggaaacaatagccgctgcggtcgctgaagcggcatagggggtgtaagcgtccacaagatatgccaatgacggcatctagtgaaaaagtcagtatgcttagctctgttttcagtcaataagtgacttactatgatagtgaatgacgcagctcctaaaaatgcagacccgatgattggaacaatccagtggattttcttggtagcagtccaaccgtataagaacaagccgagaggtgcaagcgccgcgcctacaaacaaaagcggtagtctatactcgggctttgcctctccaccatttcttttcgtcagttgtttgacaagccggtctgaaagcactgcgcttagaaccaaggcgaaaaggaatcccactccaatccccaggtacaccagcccaatgccgctcttggaaaacccgtaagccccttcaaaaactcgtgggaatgtcgtgaacatgagatattgatacccgtacattgttgccatgtaaagagagagcaaagtgacgattggaagcaaaatgagcatcttaagaggccgaatgatagatactttgagaagtttctttgggtctttcccactatcaagagaggaacgaagggatcggttactggtctcttcttgcaagcgttgtgtcttcttccttagaatcgcgtagggatatgactcttggaggagcagcagacttccaaggaaaacaagaccagcctaaataatgtaatactacgttagtccagggattaaggatggcgctgagaaacctacaagcattgacactagccagaaattccatcgccagcctttagcctggccaagatatccggcgactaatcactattagcaagtggcattgcaagagggaacctcggttggccttacctagtggaccgaacgcaggcccaagtactggccccatgatccatcccatcattgcaagccctcttttatgtaagggcaccatatcagcaattgatccggctccaatcgtcattggagcactcccagcaagcccagcgagaaacctaaaaataattagggagacgatgttgttggagagtgcgcaagcaatagtccatatgaggaacccaaagttgcagatgtggtagataatcgtgcggccgtagatctcggataggggagcgagcaataggggaccaaagacgtagccgaggaggtaaacagaggtaatgaaggcttctactgtcgtgttcgtgatgccaaatgttgacattatgtctgagctcattggtgatgtgattgtggatccaagaggcctatccaatgttagccactacccctttgaggagttgaaaatacgtacgacagaaaagcaagaactgagattgttccgatgttggtaactttctttgctgaagaccaattcatcgggttttgagggtcttcaggtccatcccaatcgatagtgttgtgtgcatctcctagatgtggctttgaagccgcttgtagaggttcgttgttatggccgacatgcttctcaatgtcttctttttgacatccgaaattcgttgtttgaacttcatcgttcctggatgtgaattctgcttcgctttcagactctttggcagcactcatcttttgagctggaagtgtttcgctagacattgtatgcagacaatggcaatcttttcaatgatagttgtaaaacaactctatgaatttcttcaaactgattctgatgactgaaataaggcgacagtaaagcttgaaatgaattgatctggatatctatttaaatccttccgagaataacatctcggaaactccgatggatcccgcgggggtgcatggctagcatcaccagatcgaatgatcgatattagtaattgtttcaataatcataagatgattcaataagaagggggacactcttcgtcgtcaggggaaattaatgtattgaacgtggttaggcggccatgggatcatcccgcggagcttcttcattgatcctcatgctacggatgccgctagaaacatcccacaatggagtatgggggcctgtgagttaaaaatcgaccagtttaatctcgcgaatacactagaagaatcgccgaagtacaatcgtaggtcccacctcgtcgtattcgtcatactggacacacatcttctggaatgtcgataaggatgcaaccatggaaccccctatccacgatgagtgctttctctccggtgatgcaacaacgttgactttggctgatagaggggcgagaccagtcatttctgactgcattcggtcttgaatacctggaaacaaggttgatcccccagccttcaagtagccagacatgtcagcagttttcttcggaaacatataacgaataggaccaacacttaccaagacaatgttcccatacagtctatcttgaagcgaggtatcagatttcaatacggcgccgaaagtgagatgctgtatccccatttcaccgttcatccccataaggtgaggatggaagagagcttcgggggtcatgaacctctctctcccagtagtaatagactttccgtctaccaatttgtagcttgtttctgtgggtgcttccccttgggccaactgcaattcccttctgaaatcttgcgcaatgtagcagtactcctccttgacatttcgggcaagcttacgctccgatattgtccccagattattgtctccccgcgacagaccttctaagaaatggtccgtcaaatgtcgcccaccaatatttagtcgttggatgccgcggcgtagggcaaacccttcatagacaggaaccgcataagtcgaggccgtgccagaatcaaccaccatccctgtgctgcttccggatgggtgtatagctaggacaccttgcatagaaaggtagagagcagggacataatactgctcaaatagtaacgtcaccgttttctccctgttctcttttgagcacgcatttggctcagctaggagaagagggtggtcttctggcttggctttgagccttttttcgtagagatagtcccaaatccactctatatcagtgaagttggtgatgatcccgtcatcaactgggtatctctggtcaaataaggggcgaagctcctccgcctcctccccataataccgatctataaggttgagtccaggaagtagacaaatgctttttatcaaaaacagtagttagtatgaaatggccctgtacctaatttttgaagctgaaagcggacgtgatatcctcattctgggatgaaaacgtagatgggagattacttagatgggcgccggtgagatataagtgttgctatgagataataagcctgctgaaactcccattacagccttagagaaagagacgacgggtcgatgccgtcatgctgttggtatctggggcttacttacggaaaacagacgatggcctcctttcgctcgcgaatccccctttaatcgtatccgtcctgccgatttcacaattcacgatcagcggacaaacgtcgccttgaaagaaattctcgatcgcaattagacttaatacgtcctacagcaacatacccagtatcgatcacaatagcctcggtattgcctaagaactcaaaatcacgactgttagctcagttctctgaactgacatccgaggtgactaccttccatgttgatctcgggatttgcccaacggtaaactcaactaatcaaaaaatcacggcatacacccagaggatgggggttgggccagcttgcccatgacagtcgacgcgaagccaggactaggcatccatttatttcttacaaggctgccatcagtgaggctgaatgcgggggatcgtatttcgtctttgtagcgcgcgttgccgagatgagtcatgtggctgctctatgctagctctgttcaaatatctatttttaccagcatcggaccaaacaattgataaaactatacccatagtaataataactcaatgaaaattaagaaggaaattttaaagaaagtgctttgcagtctagtgagttgcacctcaactcttcttagccttatgaaacttgccggagtagaggtcaagctatctaatgaaattccaaccaagtcgcagtattaatctatattttattacagttatgagccggtccatctggcctcgtctaaatccaaatctattaattttatatcggtggccctaagagatgaggcccaagcagcggagagtattcgatgagagaaaatcgtcgttccttcgtgaaagtttgccatccggtatcagtctctagacttccgcaggcttaactggcttcttcttctcgagtttgcgcaagtcaatccagcccatgccaaaggaaacggcgaaagctgcaacggaaaagcccacccagagatagaagacgtttccaaaactctcagagtaagaccgcaggatgccgtccatggttgcgctgccagcaggggctagcttcttaacggcctcggcgctacctccagcggcgatgacggcttgcacgccaacagaaggggcagcgttagggatcttggatttgaggctttcttggaagatagtgttggcgatggtaatagcaatggcgctgcacatattctggcagaatacgaggaaggaactgcccacggcgacttgggcgggaggcagagcgttctggagtgccacggtaccctgtgatcaatgttagtaggggaagcatgaagatgggttcagttggcgggatggcgcttacaatttgaatgcctgcacctcgaaatccgtaaagaatttgaaagccgatcaaatgagcaagggtggtgccaggtgcccaggttgaaatgaggccacatccaatcgctgtgccaccggctgcgaacagggcccagggaatgtaatatccgagttttgtcactatcaaaaagttaacaaaccagaaagagtattgcccaaaggggcgaaggagccggaagttcatactcagagctcccgagaagagaaggaaaataagctgggaaatgatccctgccaacatgtagacagcgctcatcgttggcgacagtcctttcacagactggaaatagataggcaggaagttactggctcccaccgtaacactcatcagaaaggcgaagttcagcgaacttgtccagactactgtctgggacaccagtttcagcggaatcatagcctcatcgccaaccctccattcccaagcgatgaacagcagagccacggcgcctgctccgcagaaaagtccaataactgtgggtgagttccaaccgtactctccggagccaaactggagggcaagaaggagcataacggatgcgggagtaaagagcgcaaatcccgtcaagtcaaatttaggtatgatcttacggataagaccaaagctcacgcgctctttttctatctggtcggggatggcgatgacggcgatgaaaagcccaacgaggccaccaaggggaaggttgacatagaagcctgtctcgaagtcagagataatgttcccaagtttcacttatcaagcacgttaaggggaaggagtttactcacaccagcgccaactagcatgctccgtaaatagaccaccaatgaccggtccgagaacaataccaatttggccaactacagtttgttagcctctgtttcttcgatttccagggttaagacagttgtcgcttacttcccatggcaacagccgtgtagacttgaaggcgacacataagatgttagttctagtctttacacaacaaatgtttggcacacatacgaggacgctttcgcggagctatggccccaacgatgactgtcagaaggccattggtgaggccagagcatcctaggccagcaattgcacggccgataatcagcatggtggaggagtttgcggctccgcagatggcagagccaatctcaaagaggaggaaaaaggcgagcaacgtccactagaggtgaagtgttagctcccggtgtaagacgagccgtgggcaattagaggcaggatatacttgccttggtgctgaagtaggtatagaactttccggtgagaggctgcacagtagcgctggcaagttgatatgcactgacataccagcctacatcctggagtcgcttaaagtcgctggtgatttgggggattgcctagacagcacagagtcagataatgcaaatttcgtgttgcgccaacggagcaagttgttaacttacggttccgagaatcgaaatgtccagcatgaccaaaaacatgaggacggtcaagcccgacattacgatgaagagcttgatcccctcaagatagttggtctcatgttcggtggtctctgtttcttcctttttgggtgccttctcctccgatatcgactcttgggctgtgctgccattcatgtcgtccaggtctgaaacctgcagcttgttgtcggccaacaagaacgcggctttgcttggcgccattgttgaggttgtggtgcgctccctctcgatcaggctgtgaagttctgcaattgtgtatcggcgctgctgtggtgaggaaagcgatatgtcgagagcagatctagaatttgagatctgggatctgaaatgcttattgagtagtttttttcccccaatgcatagaaggggggaatgctcaatttgactcaatatgagaatcccaaagcggacttgttcagtggtgcgctccagcggacttccagcggagagtggccgccggacgcgcgaatcccggagccaaacccggtcagtaagccccgtatctcgaattccaggcaacggcagcgacccggaaggtccctaaacaagcatagcccggcaatagtcgtagcgctatgcattagtgattggtcacgctgagtcgagatggtctaatttcgacaatcccgatctcgccaatcccgccgtcggcacgtcgactccggactcgtcagcgcaatgaaacctaacatggaacaatatggaattggtaattaataaagagtagcaaccgcatgacaacaacacgcaaccatgatcgacatagtacaaatgcaggcgcacgcattgggtcattgcctgctgcctgcgaaggaagaccggcggcattccgttctccaatgtcgcgacagcgccttagatttctcactcagcaacgatctccttgaaaccatacctcttatttccgtacagcgggattcagtcaagactccacaatgggtaaattgtgacatggatcgcgaatgcattgtgacctaccttaccctacaccttaaggggcttctcgggcttctagtcccatcactttaggcttcgaaataatctctcgaggtttatttaatgcattggatctcattacctacgacatcctcacacagccaactagatgattgattaattgtagactcattccgtcgtatcggaacaacgccttgctacatggactgtagccaccacagacaacaactatgagctaaatgggtgcagggctagatcaaaataaaatcaagagaggctatgtgtaatttattaacgtcggtatatcactctatgacgaaaacggcgcctatctgattaccataataattacacaggagaagtagccggggtttccatcgtattagggcgtaagcacctcaacacaggcagccttctatcagttgcttacaccatatggtgccattcttatccctgagcagcctcttttctcctagccagaattctcttatccttctatctccgggtggctagtcttaagtcatagtagctaggcaagcaaaagggaaacattcagcgaaagaaatgtgtatgatattgctacccgtattgaattgttcagaacttgaccttcaatgcggacggaacaggatttcttggaaagcctacctttcatagactgcttgctatcaacacttctcactgcattagtcaatcaccagcctatatgccatcaacacattttgcatgttcccctacagggtattatttagagcctagttggtcagtcccgacaagtctcagaaggcaaagcagcccccacgcccatacccatcaaatagagtgctttacatctatgtgttcaatatgcatagcggtgtatcgtttaatataagaatatcatttaatatgaggttacgaacttcccgtctagcagctagggcacgagctaccaaggtgggtccctaccagctgtgaacgacagtgatatgatccttgcctgatagcgttcatcgtggtaaattaaaaagtgttcttttgtcttgtaaccgaattccgtcgatggaggaagagttaaggttcgacagagtattcaaggcgctttgctttatgctactctcaagctactgacgattttcattttccttcatcggattcaacattaaggtaaataggggtgggggaagtagatattaatttcttatagtacacggctacaagcctcgttgccatttcctatattcatccacgtggaagtcagatacaggtgtgtggctgaatcaatacgtcgacccctagattcatcctcctttccaacaagttcggatgaatgtctaaggaaggaaggaaatatgattcttgaataaggcctcttgagccgattctgtactaggacacctccgcgagaccgacaaggcagtttccagtcaaaatgtgggggctgaagaatgtggaagccaccgagaggccggttcacggcatctacatcggacccgtggctgagatggatggttacagggtcctgagcttgaccaatgcctagcgttggttgcgagatgtcagtgggctgcccaatcgaaaagcttggcgacgagggttaaccagacacttctagtcctgccatgtggaaatgaacctggctaggtccctgagcgacacactcggcattatatgttttgagcccagctgccgaaagtgtgtggagcagtaaggctgtggctgcccggagagggaaaagcgttgcgatttgccggtcagcacggtgtggcggccgctgggataagggtacggcatatatgaatagtcggtatttggaagattcacgcggagacttttgaccgggaggccttcaatctgtttccgtcccgcctttcatagattaaggctatttaggtaactcgtcgagacgtgccgtgtgagtgcgctagccgcagaggtggtcctcgcactcggatccaaccatcttcgaggaaacctgggctcatagggctggccactagtgttggaagagtgtcggcgtacaccccagagaagaaatttcaaaggaagaacttttatcttgtctgcctagggtcgcgcaagtggcgctttgccgttggctaggttccgaggatgaccgcatattggtacatgtgaaaagggcgtgtttctggttctgattgatcagactgcaaactcaaaaccacccagtgaactgcttcttatatccggcataaacaattatcacgctacttcactgacagcaagccagctgaaaggtcccatgtgtgcctaacttacctatattaggtaaaagatacatggattgggcatgaaaatacggcttcgttggagacccaattcttaccgctttggtgagcagtgaagaagttgactagccaagaatccaaagatcgtgagataagccatcggagatatcccatttcaggttctgatcagaagtgacactgcagagtaaggagttgaagatagcatgaggatcaatatgtagcagttgggccgtctggaagttgttcctgcatatagagcttacagatataacctaatacaataggtttgaaaatactaaggcaacctcattcacttggtcttggccgtcgatatgatcggcaccaggggccatactgcaattcgattctgaggatctcctgtatcaacaaacaacagtcatgaaaggcgcgtgcatgggtttgggagacaacatttcacatccagacactaccgtcggagcgtgccgtaccctggtcagttttatgcggcatctttcctagaggagtaaaagtttaccgagttattgtggaccctggctaaacggggtttaactcccacggccttgcttagacgtatggccatctcccgtcaagctggttcactgattggccttgacaaggatgagagtggttcaggggagacagagttagaggggcgtctgagggcctatttgatcattaccccatatctacccccctcttcctttacttacgtacgtacgtacctgctttcgagctcgacaaagtactcagccgccaagtctgggttggccaagggtgtcggaggaggtcccagctttcccccgctacctctttcagccttgactgccttgcctcattaccatctacctgggttattgtcactggcgtgcctcggcgttcctgtcctcctcacaacgattcctctcccctatcgagcctgcttgccgatctccccgatttagacaagctagccctatgaggtacccttcccggcctgggccctggaatggggccatacccttgctttctctctgatctcataaataacgaccagccctgccagtcactatttcttctctcgacttcttcaagtgcctatatcatcctcttctgcgtaactgatctttctggaatcgttgaacctttgtcagtcgttactaccaatcaccttttcccgtctatttttgcctaagtcacaggtgacgaaaaaggcgaaccaaactttcccgggtaaccccacatcctctttctcttccttcttccaatcccagcgaaaaagacaatggtcaacttgggaccatccaaaggctgtcgtacttgcaaggagcggcgggtcaagtgtgatgagggcaagccggcttgccagagttgcctgcgtctcggtcgagagtgcggcggctaccagaagaaggtggtgcccctcaagttcaaggagcaaaatatcaactatggccccgctacattacagcgtcgagcgtctcccagttccagttcaacctcgagttcaactccttcaaagcaacgacagccacggcagcaaagtcgacaaccaaacctgaccatatcacacccaagaagcgagtgcaggacgccaatgtcatcgtctccgtcgcctgtaccgtctgacgatgacatggcagtgtcattctttcttcgccatttctgtgtctccaacccaagaaatctctacatcggaggcttctgtgacatgctaccgtcgattttggcattggaacggcgggactcgccattatatgctgctgttgtctccgtttcttcctgggtactaaccttctggaagaacggtctatcaaatagaaaaccccacgaatggcacgtacgggccattgaatggcttcgaactgctatacgcgaccctcgagagagccaaagacaatccactatattggctgccttcgtcctccaactctacgacaatttgtcggcactcggagggcttcacgaagctccccgcctacattatgatggtgcagtggctcttttgaagcgtcaacctaccgaggtgctatcttcaccatcctggagccgcatgataagccatgtgcttcatgtggaggtagccttagctatccaggaaaagcgacatttccccttgtccgagttctcctggatacaactggacctcatgcccctgaactccaacacggggcttgatattattggtattacgattgcggacttgcagtcgagattccttgctctaatggaacaaaatgatgcttctccaattgcggagcaagatcttgacaatcttctgctggatatggaagatgccgaggcccagcttctagactggcaaagcaacgttccagaccactggcattcatcttattcacaacaagtcaagctcgccgagccacccataacgtcatatggaggggactacgacatatatccctctcttcaaatagctgccacttggaacgactggcgaaatttccgcattctcctcttcaaaatgacaattggaatcctcgaccgagtacctccgacggcgttctcctacttcgacgttaataaacgggctaagatggaagcctacgcccgttcgagcatccaagatatggtagactctttatgtcgcagcatacccttccatttgggcaaccgattctttagtgggtgtttgcatgatttgaatgatcccagcatcgtcgttcccagttactatgacctggaattttgttccgacaatctgtttgaggcgacatctgaagaaaacctagccatttcagaagcttaccgccgccatgtcattggaattgggccatggcacatatctgtgccgttatgcaacctgataaaaatgatctcagagccattcggatcgtttatcgcgagatccctcagacctggacaactcgatttcgttcgtggagagctcatcagagcctcaatgattctacagatcgaggcacctgaattagaaaatgctaagaaatgggcaaggggtatgccggtcgagcatttccatactgatccgctcgacttggatgctgtggtggcgaagatgagtaattgcctctgcatttcaagcgggctttaagtgatgacggttatacatttttattgtactttttttacttttcttcttttgattttatttagaattcatggaacacggaaagcaagcgaatattggattcattacagacaagtggtctctggaccgagcacttttgcttgaaacgattttttttcagctgttcattttcatcggtcactttgaaaagtttgtagctagtagtgggacacatgccagtttcattcatgattcttgccatttcaagatggcatcctccaggcgttcttgtcgtagctgaaggctaaaggtacgtactgaaggctcctaaaataaccgccctggtcctgacgatgcatcatccccgatgaaaatggaaaaagaaccttgatggcaaacggactaatctcaaaatggcctgcgctgcgggagagagccccgtagatgggtgtgtagtgagaagctcatgccataggtcaagagccctcggggatatgacccttctccatgtgtacttcggatatacatgagacgcgttccccttccaccccatgtttcccgtatttgcgggtaagacagcaagtattcatcgtaacatcgcaacgggatattaaggtgtggtttggaatgatgagaatggactgataagaaggtcgaactctagaaggctctgcaattaaccttgaagttgaatacctcaagacttgggctaaaggattgtaaatgccgacggaatttgcaactgaaaaccccgagggaaattgccgagacctgtcatgttaattgaaataagtcaatgtcaatattatactggctataaacttcgataccttaaatactagaattagccctctatcatctatctcatggctactttgatgagaagcaaaagtttctcaaaaatatcctcatgcttgagattgacacatttggaaagagggcgatccattttttcaatcatcaacgtaaacattgctcacctacaggtctaatgagactcacatgcaggtggcggccgcccccttcagtcacgtcggcgaggagggaagtttaacaactgtccagcttcaggctgcactttcaaatccccttgatcacccttctttttaagaccagcagcttctctaagtcaccttagatctgagtttaactatgaaagacccgaaatgagaataattgtagcagctccaagaattacagagcggcaattatgaggcccgccgtgactgcaccacccgcgtttcagtggagagacccttgaccgcaactacaagccgcagaagttctcttgcactgcatacttaaacggatcactagaatagtagtgatcgattcttccggccactgaatctctctgcggtccttggctttctctagtccccagtcttgaggacggcgtcgacgcatcctaatcccccaaggctttctcactccccccaccaccggttgactatcagtccatatctagctgcgcatgatatttagtactttcgattcggcggtgataggcgtcttcacccacctgatttctgcgtctatcacctacagccatacctggtgtgggcgtgagacgaacacacgagatgcctaaaagcgtagcaagcccggccggctgcacgggaaataaacccttctctcccacccctcccccaaggcaatcgttcaccccggccaatcttgttcccacgcctcgcacgcggcttcagcccagcatgatgcatgcttttaggcgcgcgaaagactccgcgtaggcgcgctgtcaagcgagacttggggtactttgacagctacaaatctctagggcttgccccctgagccgaggggtcttgctccaggggagagttgccggggccgtcgggtgtggtgggctgttcgatgccccagtaagtactctgtactgattcttttattggcgattactcgccgacagtgcacattgttggccgatgactgacctggattgtcccttgcatgactaaactatgcagtgagaaaaatggacgcgtggcttagagggcgtcctcatcctgttagccctgagccgggagaaaccggatgttggtcagctaggtgaatcaagctttgggtatgcaacgatatcagtcctacgtataacgttagctatgaaaatctatgagttctccactgcctgtgaatcatcgaatcgagtctttgacttctttcatatggcatggtggtcattactccaccattgggttggctttcgagtcgctagagctctttaaatctaagagcttttaggttctgtcccagccgtcttcttccctcggctatgagatataggggctgatcttgattgctaaatcactgtcaaatacgtgaatctagtccaaagaacgggcagttccttgataaggggagcgtagggatctgctaacagacaaggtaaagcacgatcgccacgatcgccttttccaagcgagtgaaaactcagaactgatagaccttcatgtattatacagaacagaaggcctcaggaaacttactatgcatacttctgatgtaaaagctgcaatcacgcagttggaggcaaattacccatacattaaaaaaaacaccttcagatgcgctacatattgatttaatatgaatgacactcatagattcccgtctagacatagaggatatataggaaccacatgaacgtcatcgtgaagtggtgtgaattagtgtgaagtatgttacgagtctgtttcagtcgaggaggctcggggagctgtttgggttagcttggtagtgcaaactagacgggaaacatcgaaaatttatagtcgcatgtagttttcacaatatcaaggctgggccttccaatgttgaacttgagatatgcgctgagttaacgattgtacctcgatgttcacaatcgcgtttcagaatctcacggtgtcacatgatgcgcttgactgcctaatttgggcgtgatgtaaccagtgaggtttcatagcaaaccttttggctcattcttttcaactccgtgtcactcgactgcaaactacttctctaaaacactgctctcttgtggccgacatgacagaattgctggatctcccaaacgaggtgctctctcggatcgccacttgtctaagcgacgtggatcacaaagcgctgttcagcctgatttatgtaaacaaacgcctgaatatcattgctaccccctttctggtccggcgctggcctccagtggggggagatgccctcgagaaccccccagatttgatcgcttcgcattgcacctattgcgcaacccgagtcttcgacgatacatcaggctcctggacgtggacgacttcggtacgcgtcaagatagatatgaagaactagccatcagtgaggatgaggtgcaacggatggcgactgcgggcgtccgggactggcccgcgcttacagagctccggggacagggggagcaaatgcgggagggtatagacgatgctttcatggtgctgatcctcttgtgggcgagccatttggtggagttccacttcactgtgcctcttattgggtcattaagtcaagatggcgatgaacagttgaccttgggtttcgttagccaagttgcccgaaggctacgcgacagccctaaggacgcaatgctagatcgcttccccctcgccagattgcagtccgtccaatacaaacattgggacacggaatttggtgtgcagggccagtttgcggcgccattcttctatctacccaacctgcggacctttttcgggtacaggattgagatgactcgtccaagtaacgaagaaagcgatgaagatgacgacgatatccaaagcgcatatcttaccgagtttcccgttgggacttcaactgtcgaggatattattctcaatttttccgatatgtgtttggaggcgctggaaactttcattcgggcatgtcgcaggctgaggacgtttgccctggattatgggaacgttttagatactcgggaagttgattccagtcgactggccgagcttcttgttgcccgggcggattctcttcagaatcttacgcttgactggggcgattcaccgaccttggaaatcacggctcagggtccgctggagatcgagcaatgcttccgtcaactccaccgcctcgagtatctcgaacttccactatacatgctgtgcgaagacggcgagctcgatgggcagactttcatctcacttaactcgcagctacttccaaaatcactgagatgcctgtgcttagtgggatgcgcgtattggcgtttcgatagcaaagtagggataaacaaaatggtagatagtatcgaggcattcatactcaagtgtggcccggggggtgaatttccgcacatggaggctttggagctgatctatctcacagaccgctcccatcaggataactatacgcagcgcttaaaggagacgggtcgcagaaagaatgtaaaactggtatccaacgaatacaaatggcggacatggcctaaatatggttgagcaagtcacttattcatataggaacccactgggctgactgaggagtctattcattcttgaacgcttaaagttgatcatcaacatgagaaattatcaatacatcaccaacaatggaatattttgcgcatacgagatatttctcaaggcttaatttgaatctagattatcagagttggtctgtcagtttgaggagctctctagatcttcgaacccgacttttcattccgaggtaccctcataaaacactgttgcgtcatggatgctagcaatttgccctgctcgtcaaacaagcgtccctctgcaaatgttcgtccactcccactgtgatgaacaactcgctctctcaggttccagtcgcccatcttcacctgcggcgccaagattctcagcgcaaagtcaagagatccgcatggacccgcagcatctacccaaagatgattatgtgtcagtgctaggaaagccagagtcccgtccatgatgaacgccaaggctgctatattctcggcctgcgtagcgaatgttccacgtgctcgtagccactcagccgagaccctagaggtaacaggaatggtgtcctgggtggttggtagccctccagcgataccggtgaggttttgagctgccatgcctccagtgcaaattctcgtctcaaagtagtctctgtcttcatcgaaagactttcgaaattcttccatctgtgcctcattgacctcccctctatccagcattccttgcgcatactcatgacggtctgggcaatcccgtggcttgggccacgccatagtaggccgggcagagaactctagcatggatggttcagaagcgtgaaaatcggcaatgagttccaagcaagttcgaaaagtgccgtcggtctgctcctggctcacctctacacggcgagtggcgaatgtccttgtcgtccttgtatcatggactttacagtacagcttgtgctctttcagagctgggccgaggaagtggccgaggatggaatatgctgagaagccaggagggacagtttggcttgcagcgttgaaagcaaccccgattgtattgcctccgtatgttgctcgtagatttccaaactgaacaggtgtaaatttggacacgaatctgccgtccttcaagcgttcaacactaatttgctcggtgatgggcataacggcggcgacagctatgagacgctgatttcaataatccttttctaaatcaaggaatcggcctggtttatttacggtgaaggatcgagagctaagttgcgtacctctttgaacataataatccatgcttttttaccaaacgtacgatcgacagacaggagccgaggcaagaagtgggggagaaccgtggtcgcattgatgagccaggcgctgattcgccccagttacacagctcgactcaaaactccctgcccattagccttggcccttgtcaggggccaatacgaatttgaatcaagtaattctactaaatcatggtatgtcaaagctaaatgaaaagctttttggcgtaccttcttccctgttctagagaggagtatccaggggcggacgtcagtatctggtgcacagagctcaaagcaataacttaagtttctttacgttttaaaggtacgctcggagagtttgaactttttttgagatagctgcattccattacacgcgctcggttgattcaagatcctgctggaactcgattcgcttgaacaacaatccagtctcctccacaacagaaatccagaacaagagtttatttttcattgatgcacgttcacaagatgcaagaactcttcgcttaacctagcctcacgctgaaagcaacccctcatacagcgagtcaaggttgtgctgctggtcttctcaacgcctcgaataaccatacacatatggctagattccataaccacagcgacaccctgaggtgtcaaaatatccataatggcttgagcaacttcttcggtaaggcgctcctgaatctgtaggcgacgagagaatatttcagcaattcgcgcaattttggataaaccgatgaccattttggaggggatatatccaatatgaatctaggaatataatcttagttgtggcttcttatgctattattgaataatgtattgagtaaacggagggaatttacctttccagtaaagggaacgaggtggtgttcgcaaagactggagatatcaatgtttttgacgataatcatctggttatggcctccatggaagagtgcgccattgataacctcatttacatttgactgatagcccttagtcaaaaatagtagagccttggcataccgtgaaggtgtgtctttcaagccctcgcgcttggtatcctcgcctatgcactctaacaaagttcggacagcactttccattttcgcaaggcgtacggcgacctcttctcttttggtatacgcagctagatgtgcaacagtcagtcacatgaaaaataccatcagctgttcacaaagatggcagtcgactcatacagcctatgccatcaatacttcgtatagggctgcgtggtctggcacgcatacggtgtcgagcaccctgattggagtgggctttatcccaaacctttctgatgacccgacttccaaatcttttgtggcgcttgcgctttatagggagtgatttgttgttagctagataagaagtggtaaagtcattgtaggatttcttcctaggagaggttctacaccatcttagaatggccattggcatgcaatgaatcgattcacaactgtatgtaggggatgcaaaatatagagaataggaggttcaacttcacaaaacgtaacggcgactttggtctacttattagtttggcatcattacaagaagggttctattttaagcttggaattacagaagaagataagcaacttgagcgaaatatcagcgactgaaacggctggaggcgtagatctacccactaggtcttcttccaagctcagcgaagcgcatgccttggggatgtcgttatttctgcgggaggccgtccataagtcaagtcaaacaccaatgagatcctccgattaaagatcattcatgcctgcgagactttgtgtagtgcaaggttgttgcctaacactccgttccacgacttcgagatggtctaaatgtgacccaaaagttctcggataatatggtttgggtgttgaatccacatgttgtcatccgattcgaagagagttgcgttattgtgttacacatacgtgcttatcggagacattttcttgaccatgtttcatttccggactcggtgagataataagcatgaaacgttgcacctcaggttatgcaggaggccaacctcatcgacctaatccggtaggcagacactcaccggctatcgataaattccatacctcctgcgtggtcttctacgtggtcttaattaattggacaatgcttagaaatctcccccttggattcatctcagccgcatattgaagtaaagaaaccaacgcggtgttaagcctttaataatctacatgggctaattgccgctgaatcatgataggtccaagtgaaaaagaagaagaaaatgaaagaaggacatgtataaaacttgtaccattccattccgattttatcaatccacaatagcaagctagttcaaaggttgccgcataactgcatagctctgtcacccactacccaaaggttgctacacctatttacaataccgcgcagatttgcgtcattcaacctttatacctttatccatcaaatcccaatcatggcgacccttcaaactctgaagttggcgctgaggtatgaagcccaggcaatgatgtccccaacgcagcctctgtccaatgctcaatacagagatgggtttgacatcatgagacagtgctcggacaagtcaaattacgaggacttcatcatcccacaactagacgctctcttgactagttctcccagatatcgcaacactctttcagtgcttgaaatcggaccaggtccggaaagcatacttggagctctatctgaacatgttaggcaaaagatcagaaaatatgttgcattggagcccaacacactatttacccaatcactgaaacagtggttggcctcgcgcccttttccttgtttagaaagcccacccgatgttcgagaagttccattcactatagatgaggaaagtggagatagcgtcattggtgctagccattttgatgagaaattcgacatcattcttttttgccacagcatgtacggcatgaagttcaaggacaaagttctaaagcaggctagagacatgcttgttgaacgaccagagagtgggatggttgtggtatttcatcgtgacggagtcctacagcttgacgacttagtgtgtcataagacggcctcattccctgccggagttagccgcatccaaaatgtccctgagatactggactgcttcacacctctcattgcgggttttgtcatgcaggacgtcaatatgggtgatgtcatgcgacgaaagtggcgcgaagtgtgctgtgcgctggctcgtcgcgaccaagaccatccagagtatctcctgtttagctcgcccaacatcatggtgacctttacccgagatgcggctatgctaccagccctgacggaacttgtaccactgagtgatgggcagaggatagttaagaatcgagaggctcattctcgccatcccgtccctgtcgttgtgccggaggatgttcaacaagtccaaacctgcgtccaatgggctttggcatacaaagtcggcttgaccgtgatcggcgggggccatagcggccattgtctgtggccaaatgttgtatcagttgatatggctgcctttaatcaagtacacgttgtctcttccgacgccgagataggggaccccgagtctgatcatggtccatgggtcctcgcgggagctggctgcaacactggcgacatcatccgcaaggccgcatcagcaggtttgactgtaccactgggctcccggccgagtgtaggtgcgggactctggcttcaaggtggcttcggccacatggctagatcacacgggttggcgtgcgatgccatagtaggtgctgtcttagtcaccgttgacgacggaaggattattcatattggccatgtaccgagccaataccgaccagccagttctgtacgccctgaaaacgaaaaggatttgttatgggcaatcaaaggtgccggaacaaactttggcatcgtagtcagcgtcactttcagaacctgtgctgctctgagctattcagtccggaactgggtcttctcaattgatgatgatctccaggcacaacaaaggcttggtcatctagaccaagtagccacaaagctcgcccgaaactgttccgtagatgggtatttgttttgggataatggccggctttgtcttggggtgacagtattcgaatctgcaacgaccaagcacgctttggaaatatccgagaatgcatatgcaattcttggaagcgaacatcaccgccaagttgtcgacggcattggtctgtttgacaccgagatgtatatatccttaatgcacggcgggcacagcggtggcaagacctcctcattcaagcgatgcatattcttaaagcatattgggattccaaatgtccgcaatatcctggtcttggctctaaaatctcggccctccagactttgttaccttcatctactccaaggtggcggggcgatcggtgacctgatggggcatgactctgctttcggctgtcgaaactgggactttgcttgcgtgataactggtgtctggcctcgcaatcaggacggaactactacagctcaagaggccatacaatgggtttaccaaattgctatggacctgttgcctctaagtaacggagcatacggtgcagaccttgggccggaccctcgagatgcgccactggctagagctgcctttggatcgcatcagccgcgtctatcccatctgaaatctcttttggacccgtataaggttttagcttatgcatgtccgcttcaaatatctacgagaccgaagctcattattcttgtcacaggtaaaagctgtgccggcaaagactattgtgcaaccttctgggcttctctattcgatacccagagacttaaggcacgtgcagtaagcatcagcgaggtgacgaaacaagaatatgcagcggctactggtgccgatctgaaccgtctgctttgcgatcgtggatacaaggagcagcatcgaccagcattgacacagtttttccatgaacaggtgcaaacaagacctcaacttccagaggatcaatttgtaagagtggtacgcaatgcttcagatgtagatgtactgttcatcacgggtatgagagatgaggcaccagttgcgaccttttcgcaactggtacctaacagcaaactgctcgagctgcgcgtccaagccaaggaagatacgcggcgagctcgtcgagaattccaagacaacaatggggtccactgtggcagctggattcctgataagattcatgatgatgaatcgaaatcaacagttccaagttaccgacctgatctcgtcatgaacaatgacataaatggaaaggaatcaataagcaaatttgcccacgatcaaatctttcccttcttggacaaggatctggatcgcctttccgacatggtacggtcgatatccgactttccacgacccggcatcaagttccgtgacgtactgggcatctctcaacaacgagatgggctatccttgtgtacatctctactaaaaactcatttttcaggtgactggacccgggttgaaactatcgtttgttgtgaagccggtggctttgtatttgcatcagctctagctgcgaaggtcaatgtgcgcttggcactaatccgagaggctggcaaactgcctcctcccactgtgaccgtgtccaagcctccatctcatatctcaaatttagggcctactagttcaaagaacaaggtcatagagatgagcagtaatgtgattttcaaagggtcaacggtggtcgtggtggacgatgtactggccactgggatgacactttgcgcggtgttgcagctgttgcaaagcgtcggtgtcactcccaaggacgtcaccatcagtgttgttgccgagttccccgtgcacggcggacgagcgttactgcgtcgtgaaggctttggtgaggttaagatcgaaagcctactggtgtttggtgatgcttaagtacttgtaggtggtcttcattgactacatatcaagagcttgtgaagtagctatcgggacacctgttcaacggaggattcgccttgaatgtacggttatagttaacctagccttgaatacacaccttgtacctttgataaattcaaacacatcgaacatgaaacacgaaacgcccaattgccagacacatcaaacaagatatatacctctctcgcagagacgtcatcgaaccagccaaggtggtctggatgcaactgaaacacgcccatacgttcatactcgcctacgttccccgttggaagcagagcaaggccacgcggtgtgcattcccgcttgccagggtaggacaggacgccaagacttgcataaaccagatgcgccgatgcttgggcaattcgtccatgtcgaatcgaatcttgcctggtatgtctgctcttccaggataaaagtcttctaggaaccctggcttctcttctgggtctagccttcttatcaccccttcccgctccatcgccgacgctgacacaggcacatggcatttatcatgatcgccagctttgctgttttgtaattcaataagcatcctgtgctggtcaaagcaagggtccgggcgtctgagatcgaattcatattcggagccgtcttggtagtcgggttcctgtagggtatcctcatcttgcctgtgaatggcggcacttgccgtatctaagagtatctgaaagcgtttgaagcggcgcacagactggagaaaagaggccagaggtcttgattcatggtcgagctctggatctcccatgtagtcgtcttcgtccaggtggaggctcggctcacgggcctgtagataacatagccttttctaatggtttaccttccaaccatcaagttattgcaatgataacctcattctcttaagcaggaaagcgttggcctctacactctcagtcaaagcgttgcagagaagtatagtcatgttggagaggtcaacattgtgcaaaaattcctttgcgtcactgattagcttatgaagaaaactgcgagggctaaacgggtcactagattcagcgttgggtgtatgtttgatttcttctagtaggtgtatggtgcgctggatgtccacatcgatgtcttggctgggtgtatcttcgttatcgtagaacaagtaataccggtctgcggcgttgcgtcgaggatcgaagacggcgggtttgagaaagcctgataagactacggtcgccgactccacggtgccaaatgggcttgacccggacacgctaacatgtgtgtccaagtgtctaacggcgaaactagtctttataccccctgcttttctcttgatgtgcgtgcaatcgacggcaccgttgaaggagagccaagaccaggtcggtgcaatgtactgtcctgttcgtttgcctggtgtccagggaacccagagcagctgcagtctgagctcctcctcccacagcccggcggcatatcgataccctgaaaggcgatggatctcggccactagaccggaaaacgcgaccaacttatccgactcgtaggtcagttccctgcacgagtaagcttcagcaaggtcgagccaagtgtaagttgtaaccatggacaagggaaccgtggcgttggccgcgtgatgccgcccaagcaggctcttcgtccgagctaagtcattgtggaagtcgggcacgagatgagttccatcctcttgtactgaatggtggttacattcccagatcatctggtggccgatcccacccggtgtctggacgaagtgaagcactcgtggggaaagtacaaactcttgcaggatccagcctcgggctccagtagcgtcgacgtagttaaagctatttaatggtgtaaaaggccacgaaaagaccatttcgtgaattgtttgactctcattgtagccagtgctgcatcggagaagagatcggaattgtaaggccctaggaagccgtcttcactggtcttggcggacgtggcggatagagtgagggccgaatcgcggtagattcggcccatattctgccgcctcgcgctcccagtcaagagcatcgtcctgtacgatacaaagagcatcaatccaaaggtagcggtagccaagagagcgcgtgaggacgattgcatccttggaagtctctggaaggctggtaaacggaatataccttgtgtggtcaagaacaacattcgtcgtcgtcgtcctcaaaggcacgacaccgccccagcaatagctcacggcaacatacggcccacggctcttctcgccgctcagtaggaggtggggctcctctgttccatcagctgcgccgacgtcgattactcgagtgtgtaaataggggttcagtttcgaggagcattcggcgtggttttccagacaatctcggcaccagtctttgatgcgtgacagagatatcggtgatatagggtcatcttcgcccctattcttgcttttgacgtatgtggtaggctggaacccagctccttggattaatctttgttatattaagtatatatgatgaattgattatatacaggagaccagatatacctagcacctaagatcttgcaatctcctggatagcaccctcgtacaaatggcgcgtgctatcgctatccccagactcacggctacccctgttgctgtctacgtcaaccctcgtggtgactttaatctggctgtggccgtgatccaaagcgcccgatacagaggaattcttgcctgtcgccgttgtcgatgtcacatttgtcttgatattctccatgtgaatcgcctcccctctactggtcatcgaccgcccctttgtatccttctttgtccggctaccagaaagctcgacaaatgcgcctgtgttggcacccgtcaggtcgcttagagtgttgcctgtgcggtgctgtacgaattcgatgagctggccaaaaacggcaaattcgagcttcagcttgaccgagtaggtaatgaccttgactccctgctcccagaggaacaagctcttgtactcgatagcgagaagagcaatgttcatgacaacgatgaacacattgatggagtatagcttccaaaggaacaccctcttgctgccaaaggccgttttgagtatttcgatcgtcttccagatatagagcccagaaatgatgaactcctggacgcagaagcaagtcatttgcaccttttctaagatgccgaagacatggttgaagactacattagtaccgccggttgtataggccgaaccaaaaagaaggacagtgatagtagggtgccagatgatgccgttcacaatgatcatgcccagcacgccccgcagaatggtcgtattctgaagaaccaggtgaagcctcgagtacagaaccacagagtgacctgagaccagcaagacccatccaatagaatcaatgagcatacccacccacgcatggctgaagccgaattggatgagcatccatccaatacagtagggtatgattccaaaggaggcgagggagatgctccagaaatacaggccgctgcgtcgcttaaagttaaggaatatgaggacgaggagttcgatggcgttgtacaaggacaggaccgtggcgatctacgcggcaagggaaagggggcaattagcaaagttctcttttgggtggtttttggcaatcgattaactgagacatgagaggagaaggacacaagcacttaccagaaccaaaacatcctcggaggaatagatatcctcagtcatcctcttgagaagtctccctccgggaacacccatgaaggccgccatgttaccagccacatttggggtcaagataccaagaaagaagcaatgcatacagcccactgaacttgggatctccccgtctttttaaccatggtagaacctttccccccatccctaatcacttccatcctggtttggaaagactaatactagtatccctcaccagaaggggaatagttttctactactgcgaaggtagcgctccggggtagttagtgggtgcccaatccccatgtgctgaacgtggtctaagtcccatggcccacctccgcgaaggccgttgaggtgatgggggagctagaaactaaagggtggtgtgccccccgactagggcacagcggtgctgatctgaatcggcccaggccccgagtcagtctagctccagcgccacaatgagagtttcgcaatccgattcgctgtattgaagaatacgtacgaattacgagacggccaggttcactccgaggggatacccctgcatggtaagtcgtctctgaagtaaacgagagtgatggccaatctggaaaaaccatagagtaatgcacaaactcgggcaggacccagcctaactcgagaggctttcatatggccaagcataagacgatcatatttcactcgacctattgggtcgaggtatcggtgaggtgaaagccaaacatttcgggggaggcggatcgacgaggactaaaatccctccacgctacttggcggccggggaagcgaatgaagaatccaagagtggtttagggtttgtgactacctagactctggagggtgcacctatttacgcctcgtgacataccataaacgattccccatgaagagagggtgacattctgcagaacattaccgatcaatatttaaacctgcaatcttggttttccataattcgtccaatggaagccaaattgtctgacccacagacgtggaacgaacgaagaagcaagaggtaatacggtagaacttataagaagtaagtcggcaccgtttgatttatttagaagaaaggttccagcggagagcctacagatgtgattgcagagttttcctctatagtctctagatggatggaccagccattttgactgtcatgagatatcgtattctcttctagcaataactgatgtagtattgcgtctgctatggtattacgacgtagttacatctgcgtggttcctagaaggatccgcaccacccgagagatagtcgtccaagcacagccaaaaagacgtcatattctgccaggtggtgttgcccccctccctctcctccacaacttaaaaaacagagcgagtatgaaattcccaaataaaggccgccaaagccattattacaacaacaaattgcgagtctatatcaataaacagaacagaacagaacttcgctcttggctctcaactcgatttgacgcaatctccacgcttctagagtaaatgcctattccgcacacactcatcaagaacaactccccacacaaaccactcgctaggcgcgaaaactccagacatttctaatttcacctcagtgccaaaggtttccatcatgcgaagtatttctgcgcgcgagaaagcccagacgtttgtgttccgtggaagccgcacatgcgctatcttgactgaacctggatttcgccgaccaacgttcttgacatatgtttgcttgcgccgccttcctttctcaagttgcgcagtttcgaagctgctgtaaaaggagatgaactacgtgtgacttgaatgtctccagtgcagatgctttctcattgcagagggtgttattacataccaagcattcatgagatattcgtcaggatcttcacattgaatgccaatgccacatcgataaggcgtgtgagagagatcatcgtacaaatggtataaattgacatgttgttcatcgattccgaaccggtgaggttggaagatctcttccaattgttccatgacagatgaatcacaaagctgccaaaggcgaacgatgaccgatgctaaggatgattctggctatgatgtgaggttaaaagggcggggttcttgaacaagagtgcacaacccgtttatgtttcttgctcatcaaatttccgttccttatgtgaaacgtgagcgatctgagcacaatgactagcgcccgggttcaaaaccaactgaactgggtagtcacgacgacagactaactagctaagctaaagaggatcttaggcacctcttatagatctgggaatacttccgatgaagcctacagaagctaacggaaagaagatgaaactctcaaatgtttgctgttgtaaacctatcggctggaatggatcagttggcgaagcaaacccttcgaccaaccgagcattacttggatgtgtacaagtctaaccaacaccttacccgtagacaccgttgatgttcaatcaatcatacacatcgtgcctatccgtggaccatccgttcagatagatgctaggcaattgggcaatatgaggaccagagaaacggtttggcacaataaatcatcacgcgttttgtggtaccaccagaactagtcgcgaggaatagaagtcttgaattcaaaacactaaccctatcatatatcaaaagcgcggacttactccaatcatgaagtagtcggcgaagccctgagtaaacccgtggaaggctactcatttcggagtagccctatcagctcagtagtcatctccacgactcacgacctcctttacggtaggtctgagcaggacagtctggcgtgtcatgtcagtcgaactgtgtgcagaatcaacccatcgtgggcgggaaatcacttacatgctcaaattgggccgtgtaggagcctttcttgtccaccaaaggtggatagtcttcgacgatcccagacttgacgaggtggttgagctgccgatatgttagcgagtgcgcatcagaggagaacgtgattggttgccttacaccgaggaggtatttctcctgcccgatcctgtccaaataacgtcggcaaaagggaagggtgccaaaattcttcttgatagcgttcaagacagacttggcggaagacaagcgcagctgcacgttgggcgcgtcgccagacagggcatagtgggagacttcgccctgatcgtagacacggccattaccagtgctaccaaacggctcaatggcaaacacgtcgccttcctccatcttggtatcatcatcagtcaagatggaaggtactgccttggagccatggatgctgtagtgcaggatgttgtggccggtgatgttacgaatgggcttgatgggataaaccttgccatcaagctccagctcgtagctctccatggcctcttggatgtagccgccgagttctccaaggcggacatcgatccctgcctcgcggatgcctgtgttcgaggcatccttgacggcgttgaggaggttgtcgtatttggggtcaaacgacatggtgaaggcgctatcgacaatgcgcccattgacatggacgccaatgtccaccttcatgacgctgctctgctgcagaacagtcttatcgcccgcgttcgggctaaagtgagccgctatttcatcgaggttcaaaccaagcgggaaccccatgcccgcgacgatagcgtcgccctcggttaacccatcgtggccgacgaggcggcggacgctgtcctcgatgccgttggcgatctcggtgagcgtctgacccggcttgatattcttctgcgcccactggcggacctggcgatgcgtttcagctgcctggcggaagtcggcgagatagtcgctgttgaggttgtcgagatagcgtttctcttcgtttgtggtgcggtacaggttgtcgtccttgtactcgacctcttcgcccttggggtagctcttgttggggaagagctgggacatgaggacggacggcgggtcggtctgggcggtcggagccttgttcttcttcttgcgaggcctgttctttctcttcttcttcttgctggcctcgccgtcccccgcagcgcccggggcgttggttacatggtcgtcggcgtcgtcgtcggattcgccggagcattcggcggcagcatcgcccttcttcggcgcgcgattgccggcacctccgttggtggctttggccgcttccttggctgccgactgttgttaggcggggctggttcttgtctgggagaggtgcgactaaccgttgagggcctgggtatcgtcggccgggattctggcagccattttcgcgaatgagaaagtatgtgttgactacaaactcgagtccagctggttgtatgtttgaaaagtgaggcagttgtggagaattcttaggtgggatggtcgcgtgagcgagcgttgtgcagataacagcaacatgcttctaccggggctgctctcgtgcgcactcgtagccgccttagagccatcaaggccatctcgtagttaccattttattgtaaaacgaaaggagttaaactaagttctgttggttttgtttttttctaaaagtgattcgagatttggtcaaaaacgtactatgcaagctcggttcattcgtagttaattatagcgattctctaccatacggataggagtggtgcgacatacagaaacagcacctctgataatttagattgtatggcttgtagcaaccactactcatttaaatgttatcatgcattttacagcctcatcgaagactacctgggtagaggcaattcaacggacttaggtatagggtaggtgccccccagaggttcggtcaacaggtgtagatgtcagaagactgatcgcaacaattcatttggtgataaacggcgacaacattccaaaatatgatagattaatatagtacatttttttttttgaaggatctgaagtctggctatattttgataacacctgatgtaggctgtatgaggttgaataaagcttgcaagtgccgatatatatcacgatcaagcctgttgaaagtcatgtcagtgagttcatctcgattttgggtatgaaacgaagatatcatcggtctccttctcgcgagtgaccgggctaagctcgatttaatcagcgctacgtttgctctgagtcaaccgcccaccatccgctgccgccacttggcaaagtctttgaatcgaggctggtttgtcggcgacagttcttgaggaaagattcagcaccccttgagagagccagaagctgtattgggtgctgggagcatccacggtcggcatagtgttgctcattcaaggcgtcttgacagcatcttccccctccttgccctctttctcgtccttgtcgcttcgcttcgtaaatatctcgtcgataacacctagctcaagtgcctcctccacgctcagatacttgtcgcgttccatcatgtcgttgatctcttctatactatatcggtcgtggccctttgctgtgttgagatggtattgcatgatcttgttcgactgctcgcgtatacgttgaatctggtttgcgtagatgagaatatcggaggcctggccccgtgttccgccgagaggttggtgaatcatgatggagctgtgtggtagggcgaaccgcttgccggcctcgccgccggcgaggagaattgcggccatggatgcagcgccgccgacgcagatggttgagacaggggatttgatataggtcatggtatcatatatggccattcctagtattccatgtgagctttcgtctcgagcttcggcggagattaatgctcacccgaggtgacagagccgcctggagagttgatgtacattgtaatcggcttgtcgggggtgtcggactcaagccatagcagctgagcaacaatagaagcggacatatagtcgttgatctcgccattcagacagataattcgctcctgaaagtggagttagcctcgaggctttggtgggctggagcacgcgacagaggggtattcgtacctgcaggagcttggaaaagatatccccttccctagaaatcagtcaatggtcgacaagaagggcggagaaggaagcgtacaggttttcctgcctgcggactgctgctattagtcttgtcttggtgttaccatcagcgcctggattgcgacgactcactgaggtctcctcgatgtagggtgtgggaatgtacaagtccattgacggacgtccgccagatgacgagctcccgaagcttcgaacatgctgattgagtagcggcagcctccgcatgtacgaagaaagcagcctcgcgcgtggatgcatgttgtcgtgctggcggaaccggagatgatcagatccgctatgccttgccgcaaagctgaagtgacgttggtgatgggagagcttggccatactacgctaaaccttaaaaggtatatcgattagcgatagcctctcgataattggtcttggcgctggtctctcccttgtccgaggatctgccgctcaaatttcccgaagcttgtcttaggaggaatggctgttgatcccggagccgagcgaagcccaatattttaaaacaatgttgaagggatcaaggcgatccgcggtggcgctgcggccaggttggtgcccggcatcgcgtcgcttccgctcatacgacagagacgaattgacccccgaggccctccagcggcaggtggagagtggtcttggtgacgatgcgctcggaaacccgatgcgagtcgaccccgacgcaaagacggtatctacagctgcaggccccttgccaatttcgccattattcgatccagaatggattggctctaggcggcgatcgaggaagacagagccttctcagcctatgggaaggtttcggaagaagctagccctcaacccgtttggtaagttggttcacgcagctcgagcagggaatgcatgctaactaggatctagcgagggcattggcgtcacctgttcgtctctgctctctcacctcccgtgccctaccccgatatttcctacaagacattgaggttgttcgtcaccccgaaacggacaagcctcatcttgtaccaggtccgctgtctttccacagggtccagccaaagtactgggagacgaccgattccacagcaaatgaaatcgatgaagcgaaagaatcaacgagtacgggtggggaaattgcgaccgcgaacgatccagaaacgaacaactatgagggtagccccggcgacgcagagcgtacaggacgagcccccataacggcctatatagtctcggataaaggctttttcgatctggtaggagggaaaaaaccgatgtggcagcgcaaactactagggacgcgttcagggagcgcgacgttggggtcgtttagagaggccgaatttgctcccaatactggtgacctcctcttggggatgctgcgtcgggcggcagtagatgcactcattgcacgatcgaaccgaacccaaccacctttggataagttcatacaacccgtcaagagctgggaagagattggacttgttcgacgacgaggctgcatactttggctgccaacacggcaatcacaggaccaggaaaaagagggattggcaaagacgagatatgcaacctatgatttgaaggatgtggcctatgaccggaagatgccggtccacgacctgaaatggttgctgggggatgaagaggtcgcgcgactgcgtgccgatgctccagatatctttgggagtggtgagctttttgtgctgaagacttggaagtcacacagcatggtcaacctgcatctcctgttgtggaggctccaagggtttatgccgcaagaacaagctcaatgatgtgagtggtgagaggacattcgggcaggcccgaactcctctaaggttctgccaacatctggcaacgccgcttctacttaagtggccttggtgaatgtatttgacttgtccatatagcggctttggatctcatatgccgcatagtcactttgtatgatgacctggaacgatttaaaggggttacgttatacgaacagaggcgcattggcttgtacattgtattaattactgaatgaggacctgggacaaatgaatcatctgccttccatgacctctgcaagctgcgacgagagcttgcaaatcgttgagaactaaggtaattgagtctcttttggtccaggatgagtgcactcgtgtatcatcaagcgctttggcagcccaccattccattgttggtggaaggggacgaggacttgatctttggttttggttttatacagaacaaggtttctcaacttaacgcaacacttcgagccggagcgcaagagatggttgatccccaagcccgaactttggtcgggcaaatagcatccagtttccccgcctaatttaaagcgcttgtggttgatgaggaaagacctgtcgaagatcatatgtcgccccgatcgtgccaaattgatccaggcgaccgggtaaattccccccttctaccatctgcgaccgttgtccacgcccctcggtagaatgttccccgggttcttgcccaccctagaaaacagctcggtatggcgttcggcaaaaaggttgacgatgtagaactaaataataatggcaaaggggtggagataggctcggcttgttcttcagcgaacagatgctttcattgtgatgtctgatcttcagtataagattgtctcctaacaggactccgtcgtgcgccttctgtttagcatcatccccaaccagctcaaacatggtacgacatctaattctttcgtcgttcgtcggggttgtggttggatcatcgtgctggagggataccaagtgtacaggcctggaggaagccgtgtttcctggcccatgggacgactacaactacgctccatcctccaggactgtccgccccaaagcattcttttcgctcaatgatacctctaacgtgatagacttcaacacatccactcctgcaccattgtctaatgacctggaggcccttgtattcgattttggcctggaagtcggcggcatcatcaccgtgaattacacactggaaggcactgcagcagcttctcttggaatcgccttcactgaagctaaggactacattggacgaaaatccgacaactcaaatggcggcccgggcgctgatggctcgctcagctatgccatcaccaaggaaggtccaggaacgtatgtcctgcccgatgcgaagctccgtggcggatttcgctacctctccctgttccttgattcgaatacaacggtaagcctgaatgtacacgacatcagcctggagctcgtatttcagcccacctggcccaacttgcgagcgtatcatggttactttcattcaaacgacaacctgttgaaccggatttggtacagcggcgcgtacactctgcagtctaattgcgttcctggaaacacgggccgccatcaaacgaacctgacggatggatggcagaacgacgaatatattgggcccggggatacagtccttctggatggcgcaaagcgtgaccgctgggtctggattggtgatatgggaacggctgtcccaagtcaattcgtgagcacgggagagcttgacagtgtcaagaatgctctgctagccatctatgcgtaccaggtgagttgcccagctggattttaaaagatgtactggtatcttaccatcatatctaccctagaaaagcgacgggcaacttcctaaagctgggcctcctcataaatcgacagatagtactagtgcgtctacgttgaatatgcttattgttggtgcgcaactgacgacctctagcgtaccatctctgggtgcttatcggaacatataactattatttgtacactggggacgactcattcctcgaagataactgggagaaatacactcgtgccctttcccacacgctgggcacattgacagaggacggaattgtcaatataacgggaacggcggactggggacggtggacctactctgtccaacgtgcttcagcaagcatgctgtgagtttgatagtgctacataagttctcctgatgagatgagctgacacttaccagcctttaccgggcgttggcgacttgctcatcgatacttacttggtatcctggcctcgaaggcgacgctttcacagccgaatcttgtcttgagcgttcaaaaacgctccgggagaacatcctcaaagccttctgggacaactccaaaggcgccttcatggacgagcccaacaacagaacaatgtacccccaagacgccaacagcatggcactcgcatttggcgtcgtctctccgggccacgacgacaacaaggcggatcgcgtctcagactacctggccagcaacctgacaccgatcgggccatcatgccccgagctgccgaacaacatatcgcccttcatctcgagcatcgagctggaaggccacttcaaggccgggcgctccgaccgctccctggcactcatgcgatccatctggggctggtacctcgaccaccccaacggcacggcgtccaccacgccagagggctacctcctggacgggacctggggctatcggggcgaccgcgggtaccgcaacgacccgtcctacgtctcgcatgcacacggctggagcagcgggccgacgtcaacgctgaccgagtacttggtcgggttgaccgtcaccaagccgctcggcaggacgtgggaattcaagccggccacattctcggagctgtcggaggctgaggctgggttcaccacgagtcttggcaagttctccgccggattcaaggtctcgggtgggaggttgacggtgcgctgggatgtgccggaggggacggagggaattgtttccttgcctggatttccgcctgagagggtgcagggtgggaaggggacgatgaagaggctatggtgattggggaggtgtcctgggagttatctacctatgtaaagaagttgggccagtacgtagaactcgtaaaccgcaccgtcaacgctcctgggacccattacgttgcacccgaactccaacctcatttgtgtgtgaaaatgggagctggattcttctcctcgttggtgtcatacctagcagttttatcgaattgcttgaccccatcacgaccgtcatctactatgtacacccacaacctctccgccattaagcagctcgaacattccgccgctggaagaaataagaggtcgagttttccggcgagtgtcaatgaatcccgagtcgcgacccgcaatgacccgttctgctccaccaggatccattgtgacagagcatctctcgaggatctttcatcattgtgcaagtcagtgaacaagactgcggcctttctgtagactaattacataggggccatgttggttggtcgttctgattcattcttattgcgacattttcgccattttcgctagtttggccggaaaatgtatatttctatcagtcattgtaatgcatatgcatgtaaccagcctttgaatgatctccccgttcacatgcttatcgtgaaaaaaatgattgatcttgggcttttgcctggactagttgtgaaagttgaccgataagaaaaggagggacgcatcagcctagatggaaatggtagaataagcttgagtcgttgatctgggtactgagtgtcgtttgctgcagaggattattctcaaggttgtcttctctgaaagataattttttcctcctaaacgaggatggatcgccatcgagggatcatcccgaactggccaaatgccgcaatttgactgtacacatagaaatctgacgaagcattgggtgtttcatcttggttcacctatgagagttaccgccaaccagcagcaggtacatgacaatgtggctggccatggcgctggctcgtccaatgcgagcgcaagcggcggaaaagttttaattcatgccgcctgaaatctcttctcgtcgctcacgcatgtacctgctatgacatttcacctacaggtacaagactcgcgtcagcacgagtgagtggacaagagtagctacgggctggtttattatggggaagcggcagcaacagtaatgggattctgcccagtggccgcagcgctggcgaacgcctgctgcagccgctggacacagacccaatttaggcccgttttcatgacctcatagcgggtactcagggccattgctgcccttagcctttatcgcagagcctgtagcggggcctgcagcttgtcgcggccactggcagagcccgctgtcccttatcgggcggctgcccctccatccatcatccgctgaacggagcacgatggaggggcaggcccactatagcttcaggtacctgccaccgacattgcatcttatcgtgtcgcgccagtcaaagcgtgaaacctttccttcttctccttacctttttcctgcttcttcttcgctttctttacatttctctcaagctcaccattgtcattgatttacagtttctgtcttttttggttaaacgcagacaggatggagtacgataccaagacccgtgagtggcttccatcccgtcgtgagtttggaaaccagcatgttctaatcatctttggtcgttttagcccagtccattacctcggaccccaagtccttcgccagcgattcagtccgtatgcgatggcctaccatcctggttcgtagaattggccccttcctcttcctccagctactcaattggccccgaattctgactcgacctttcagacccaagccattcaggacatcaccaagtccacctccaaggccgagggtgctgagaagcaggccgagggcaagaagatcattgagcagctcaccacgctcaaggacgaggtggtaaacgacgccaagttgacgtatgccgctctaatccctacaattacctagatgacgtcgaattaacgtcctccacagacctattgtcaacgacgagttccccgacgagattgctgcttataacaaagaaatccaagaccgaggaaatccctcctggttggacgtcacatggctcttcgccgagtgctacatgtaccggtaaggcatcctctgggctacccatgttgtgactgatcgttttctgtgaagctgaccaggtgggcactttaatagacgcattagcactttcttcaatctcaccaagcactggaaggagtatgatctcttcgccatccagaagcttgacactttccgcacatctcgaaatgctgtcctcgagctagcctcgcggtacaaggagctggtctccgacctcaaggccgacaaggagaagacccacaacctcgaagccgagaagattctgttccaggagttcttcgagatctgcctttggggcaacgccactgatctctcccttctgaccaacatgacctacgaggacatccagaagcttcagggctcagaggctcgcaaggccgcggagcaaaacattctggtcaatgacctcccccgggcctatgagattctcaagaaggcccgtgacgagggcaagaaggagcgaagaatcgattttgtcctcgacaacgcgggcttcgagctttacgttgacattatcctcggcggcttcctcctcgccaccggcctggccacccagatcgtcctccgacccaagtccatcccttggttcgtctcagacgttctgcccagtgactggactgccacactcgacgctctttcggaccccaagcgtttctttgagactccgaacgacgatgagaaggcacagggcaaggtcccagtcgccctcaccgccaaggaggagcaggatctcctctttgtccaccaagactgggcttcggaatacaagaatggccagatcaccctggtgcctaaccggtactggacccgtggtggcagcttttggcgtctccctaaggaggctcctgagctacacgaagagcttaagcctgctgagcttgtcatcttcaagggtgaccttaactacagaaagctgactggcgatgtaagttttgacacatccctggttggcaattgaggcgaaatcatttctaacttgttgcgacttttttaggctcactgggatactactactccattcccccaggctctcggtccattgggtcccggctcgggtgtcaatgtcctctccctgcgaacttgcaaggccgatgtcgtcgtcggcctcaagcctggacaagatgaggagctcaagaagatcggcggcgacatcgagaccggcgctaggaagtgggcatggcacggcaagtgggctgtcgtctccttgtcacaaggttaggttctttggtctaccaggacctctcccattctttacgttttatttgtcatgacatatcctatagagctacatgatagaatatagagctccatatagacaagaaattatagaaagatgcttggacgtaccgccatggattggccgggtacgctaagcgagcaaaagcatgcatgaatcagaagaacagttggataattcaaagctctcattgtacgcctaagcctgtggtgattatcctccctgaactccatacttcactcctcatagtaagatgaataacacgtgttataaaaaattgtattgaaattctggtatcacaatctatttctgaatgagtctatgcagaagctgcgttcaagctttcaaacttcgatttgctttgaggatcgaagtaaggcttctcgccgataccgactacgcgcacaccaaaacggtcgccaatatcgaggtagtcaaaagtagcagagtggaacacactacggttgtcccagatggctattcaccttgagttagcacagatcattctaatcgaagttggttgatgctcaccgatgtcattaggatgctgccacttaaggcggacctgaagagtatggtctctcgccacgatcttgaggaaccatttgagaagattgtcgctctcctctttggtcacatcgttgatgtggccgacgtgtcctccaacggggaaaacactcttccagcctgtgacggggttggttcggacaacggggtgaacggctttcagttcacttcctacattctctggagatcctcgctccgcatcatagagcttgaagccatttcgctccgctgcctggctgaagtatggctgcttgaacgtgacggtcagagactctaggaacttttgataggccgggctgagtcggtcgtagatatcatatcctgatgcccagagggtgtctacggaaaaactccagttagaattaccaagacttattagaggctctaaataaatactcacctcctccagttgctggtagctccgtcaggcgcagcgaggaatagtctgcggggaccggctcgaaggagatatcggcgtgccattgggggccttccttcttgtttgggacgacgccgtcgttctcctctggtttcttatagatttgcttgtgctgcttggaactgatggtgctgatttccaggtcatcgccacccaggtctcgctgggagttgagcactgggtggatgtgcagccccgaggttgacggacgacctgtaagctcgccgagcttgatgatgagcttcttctggagctcgttggtgaggttgtcctgtgcgcggaagaagacgacacctcgctgggagacttggggttttcaatagttagcacgcctgctcgtttgactcgttattctctgcggtgggagtggtacgaactggtaattgccagatctcggatcaagtcatcagagtttggggcattgagaaggtctgccaagtttgccttggggtactcgcgaccaatggcaggagtgacttcgaagtgttcatagtcattgagagcgcccgatagttggaggggagcggggtacttggacttggtgttgacagagtcaacctcaatagcagagggagccatgatgagaaaattgataagacttggcgagtttagagattagctgcccgattgatgttgcgcttgattaacacgatgccgttatatcgcgagatcccctctcctttttataattgaagcaccacacggtcatgtagctatcctgacacatgacacatgatttattctccaagatctaggaggcctgtgattacaaactggcgattgatccgacatccggtctcacgttcttgattaaccgttgcgtgggagatatggcgccaacccccagccacatgtcgcgatccccccccacagtttgggtgtgtcgcatcttgacaataacaagtcgtgattcggtcatctcgagctaatgcatcccgtatgcatagttcatatctcaaatttggttggaaatgggaactgaaagagtaatgattggccgtcttgccatgctcccacccctcccaaaccgaatggcgaataggcgctactctattacgtgctctgagaggataaacttgggaaacactgcgccgataagaagcattgtacagtaaaacagacttggcattaattaatcgatacaaagctgtattctctaagaatatgacagcgagtcctgtaattgatacacggagaggttttcgaaaccagagacagaaatttggtctcgattgcccaagtggaattcctttccctcctggtcacgataatggagaaatcgcaaccgccatggatctctagagtacgctaacatgtgtcatgctgcatattgcggtcatcggcggcggacatcgcaagttgcgccagtttgaccagcgatgccatcatgaacatattcgtggacactcctcgaccgggccatggatagcatcccgcggtttcgtttagttaaccccacccaggagcatatttggctttacatccgaggttgtagggcaatattcaatcttccaagaggggttgtcaataaactggagccgtcgatgtagtcttacactgtgtttcgatgttgatttacactgctctggctcgaagagaagctgatttctatggaattgtctcgaaagtagcttgtgaagaccagtatgacgggatcaatgtccaatgtgatacagaatgcaagttagctgcgtgcacctcgagactattgagatgccgcaatcacgtctccgagaagctgaggtgaactgttggtttatcttatccatcccccttgtttaccaggggtctagaatatcacatcactggttcagccattgttatcgtgcgcgtttgtcaaaatgtcgtgctcaaactccctccctgcgaaatcaggatccgcaaaccacccaaagacaccctataaagaggtgacgccgataaagttttgaaatcatgaggaacagatctcatatcaagccgattagcgaatacaacaacgacactcaaattttaattctccgttcaccgggctgagttatgtcgacggctttcgttcggcgtgccgatcgcactgagaaggcatacacttcctcgtccgacaacggcgaggacaagagtaattcttcacaggtgttgtccggcactgagaaggagcagtatgaagtccaggcacgctcattggctgatgtccctccccttgggtccccccttgcagagaacaccttctggtggcaacgctccaagaccatcaccgatggggaagctatcgccacacaagagtctgtgttcgatgatccggacctggcaaagcggtaccagccccgggcagactgggagaatcttcatcggttcgacccactggcgcggtggacgatcaatgaagagaagaagataattcgaaaaattgacatccgcatcatggtcttcgcttgcatcatgttcattgctctcgagctggaccgttccaatatttctcaagctgtgtctgacaacttccttggagacctgggaatgactacaaatggtatgtatcagtattctacagtcagacatgcaaccaaggcgctaacatatcgtagattacaatcttgggatcacagtgttcaggctgtcgttcctctgtgccgagttgccatcccagcttattagcaagtggatgggccctgatcgttggatccctcttcagctgtgcctgtggagtattgtttctggggttcgtatttcgcccatgataatcttgaccaagactttgctgaccatcgcttccataccaggctcaattctggctcaacggaaggacgtcgtttttggcttgccgttctctcctagcaattctggtaagtaaattgctcctgaacaacttttttttagagaaaacatgtacttacaatacttcagcaaggaggattcatcccggatgtcattctgtacttgagctacttctataaaggagccgagctctctgtccgacttgcttacttctggaccgcacttcaagtcgcagacattctttcaggcttcttgggcgctggattccttcagcttcgaggccttcacggcttggaggggtggagatggctcttccttttcgaggtatgtggaggatattttccatatttgcgctatgagctaacctgatacctcacatagggcatcctgactctgcttgttggaattctcgctattttcttgatgcctgcagggcccactcaaaccaagggtatcctgcgtggcaagaatggttggttcactgaacggtaagtgaattctctttcttaataggattaccaacactgacgccgagaagtgaggaaaccatcatggtgaaccgcgtcatccgtgatgacccaagcaagggagacatgcacaaccgccagccaatcaccccgaagttgctgctacagtctctggcagactacgatatgtggccgctctacgccattggactcgtctggggcatccctgtgaatcccacgaaccaatactttacgctcatgctccgcaagctcggattcagcgtcattattacgaacctcctcacggtgccgcccatggtactctcgatcgtaaccatattgggcatcacatacctctctgaaactctgaagcagagagcctacgtcacagtcatatcacagatctggattctccctttcctgatatacctcaacgtcgtcgacatcacacagatcaacaagtgggtgggctgggtcatcttgacactcttgctcgcatacccatcacgtaagtcgcagactttaagccagaaaaacagaattaaattgtataacataactaatcatggaaaaacttcaagcgcacgccatccaagtcagctggaactccaagaactcgaacgcggtgcgcctccggaccgtgtccgcggccgtgtacaacatgtccgtccaggcctcgggcatcatcgcctccaacgtgtaccgccaggacgacgcgccccggtacgcgcgggggaacaagaacctcgtggcggtcgcgtccatgaacatcgtcctgtactttttgaccaaggcgtactacgtctggaggaacaagagccgcgacaagaagtggaacgcgatgacggaggacgagaagaagcattatctggacacgacgactgatgaagggaacaagaggcttgatttcaggtttgcgcattagacttgcaggggtgggatgatggttgccgccggtttcagattcgtaccgtggtgagggtgtggccgtaatctgggggcagatgtccataagccggcggggggaggtactgtgaagccgaggaaaccgtgctcgattcttgtccgcttgggcctgtggaactacccggggtagaagaaattgaagaagtttggctggataaagtcgatgtggtccaccctcctgttgaatcagtggtcgagaggccaaaactgtagtctccggtgctggtagccggggtagatgataccacagctcccgaggacggagtgccccgtgaggtgaatgaagacgataaggttgttgagattgaggttccaactgaagatggtgtgatgcccggtgtagatctcgaacttgtaccaggccttgccgcgtcacttgaggtcgttgattctgtgggtgttgacattgacccaccactagtcgtgcccatcccactactggtagatgttgtgaaagaagatgaaattgaagagtttagacccgaagtcatgctagtagagttgctgtatgaagaactactgctcaagctagaggggaccccagtggtagttgatgaagatggggtagtgctaatagtggaagatttctcatctccagtcgttgtgtaccgggtactggatagattcgttgaatcactcaagctcgtcgacgtcgatccaggcggagatcctcgagatgtggtagatattggtgtcgtatccgaagaaaccgaaatcgaagaggagccggagctaagagaaggcgttgtcagttgagatgttggagatgactgaaacttagatgttgttgaaatggtggtctcgaatgaggtggcaacttgcgaggatgacctggtttcggttctagaactcgatatctctggagaagacgtcggtgtcgagttgacctcggtggaagttttgctagactgaacctgagatgttatcgattgactggacgcctgggtgaaactactgggtgtaaacgaggaagaattttcggtttgagaaactgaggataccgtggaagatggtgacgatgacagctgttggcttgacgaaccatggcttgacgtagtggctggctgtgaatagtccgtcgtttgtgttattgtggaactggaaattgaatcggtaatcgaattgctcgaagatggagatgatggaattgacgaagcctctgtagtcgaacgcgaagatgtctctgaggcatcagagcgagtagtcgagctatttggcgatgtggcgtctgagcgtgagctacttgaagaattttctcgactacctgttgaggtagaaggtgatttcgaggtagtatctgacattgaggtcgtctgaatactagatgaatcggtattagggctcctcggggtgctagtagttaagcttggggtagaggagattggcgctgtgaacgtcagacccgtcgtaggcgcggttggtgtacttgaactcaggtctactgtcgaaccaccggaagtagtggaagttaggccagttgtcgatgcggtaggcgtacttgaagtcgaatctcctgaagagacgccgggcgtagtgaaggtcagccctgttgtaggtggtgttgctgtgctcgaagtcaggtctgttatagaagtaccaggggtagtgaaagtcaggcccgtcgtaggcgcggttggtgcacttgaagtagagtctactgtcgaagcactaggggtagtggacgttaatcccgtcgtggacgctgttgatgtgcttgacctcaggtctacggtagaaccactaggggaggtgaaacttagacccgtcgtaacggctgttggtgcagtgaaacttgtgtctcccgtagaccccgttggtgcgcttaaggtcagacctgtcgttggtgctgtcggtgtagtgagggtcagacctgttgtcggtgtcgttgatctgctgaaactcagatctacggtagaagaactagatgcactgaaagtcaatccagtggtaggggctgttggcgtccttgaagtcagaagggttgagctctcagtcgggttactgaatgtcagaccggtcgtgggagccgtcggtggagtgaaggtcgagcttcctgtagacatcgacggagtagtagaggtcagaccagtcgtgggtgcggttggcgtgcctgaagttgtctctgttgtataactgttgggtgtcgtcaaggtcagccctgttgtaggcgcagtgggtgtgctatcagttggtatgctgaaagtaagacccgtagtaggtgccgtaggtgtgctgttactactactgctggctgccgaaggctgcgtcttcgtattcgagtagcatggcgttttgatactctcggtgcaagtctcaacactcgtttgggaagcagcagaggagccagggcgagaatagtttgtagattccgtcacggaccggcttcctgttggagaaacacctgatgtttgagatgtcctggagaccgagcctgttggcgagcttggatagctcggggagccaggattcgaattggaaccggagatgctcgtagtatgactggaccctgtagagctccctaacgggatagatgtgctagtcggaagcgttgcatccgacttcccagttgttaagttgtcgctttggctggaccctgagccgcttgatgtaccaccgggagctccggggcttgatatgctgatggttgtaaacttagagacagtgatgaaactggtcgaactaatctttactgttgtcgttcggtctggtggactggaagtgaggaaacccgtactactgatatcacgcgtgccaggcggagatgtattcggcgaggtaggcttggtagaggggactaaggaggagtttgagtcgggtgatgaaggggcacttggtctcccgcctggagaagtccgtgttggggatgtattcatcgaagaatcttcggctgtgctccgacccgttgacaagggctttgatgacgtgattgagtaggaaggacctgttggagatggcgtccccgaggaagcggtacgggtgccttgagtcgtgccctcggaccctgagctggaggatgtgatggaagaggaaggacccggacggtttggccgacctggttggctgctcacagattgagagaaagttgagggtgatgatgtcggcggcccgggagtgaatgaaggcatggtctcggtccatatggtttccgagggcatgggagtagaaccaggcccaggagacgaaggagtgatgatgcttccggtccgtgtagtcgaagtggtgcagatgtatacggtagacgtgcgttcaggaagggtagagtagcatgccgagccgcaagctgtaatagtctttgtcacagtcaccgtcctgtcctgtgcaagaaccgaagttaacctggtagaaagtgttaaccgacgacacattgggcaagttaatttcaagtgaacgcctacccaagggctagaagcacaatttgccatatcatgctcgacattttggataaatggaagaagacttcgtctgaatgagtgctgtcgaggtctcagaggaaagagggacaagttccaaagtaagcgacagattcaagaccattgccctcaactcgctgatgtaaagcatcatatcttcgccaaacggaatgacggtagttcacataccgcctttataagttttgctgtgtttgatacacacgggataaataccccctcggtcgccacataactctggcgtctcttccgaattggtgtattcagctgcatggtagtggaaacacgatatccctaatcgaaaccccgtcctttacatttgccaagtttctttggacgagcctggtcctgtgatttctttcttgttggggaatgggcagcacacacacatgagcttggataacccggtatgatcaccgctattagtccaaagaaggaaccagaagatctctcatgtctttgaactcaacttggcacggcatataatattgcaggctacggcatcggtcgggggacccgaaggagcagcctctgagacatttggagtacaatgagcgttgctggacccaacgcccgaaatacctaaaccagaaaacaaagtccaatgaacatttaggcgagggcttactttgtataagtagacctgatttcctgaaatcatcgggactttgtaaatatcaacctgttgtctaggaaatattgtgttcggtgttacaggctgatgatccgagagtccagttcccaggaaccaatgtccactcgcttaattaaagctttaccatcgtttctgttagactgatgatctgcgctatcgttaagaacccctgaaaatgtctaagtcaaccgccctcaagctccgttctggactcaaatcgggtgatacaccacacgaagctgtgctatgactgagctctgtggcttgcttcagctcaatgcagccacacgagccatctctattcacgacatatatgatacaggggaggcgtcggaaaacggtcatatttgggtataaaaagcggatacgatacggagcacttttgtggctatacacgcacatctatttctataacgtgaagctagctagtttattgattttacactttagatggatgccttgaggaccttgaaggcatcagctgcccctccctggaagcgagtctctgctgtcttccagttgatgacattccagatgttctctacataagcagcctttccgttgaggtactatacaagcaaagagatacattagcgggccaatttggagccgagggctgagttgagaatgattagacatacctggaggtagtaggcgtgctcccacatgtcaacgccgaaaatgggcacctcgccgcccacgacggggtcctggtccttggtggacacgatgcgcaacccctgtgcgtccttgacgagccagccccatccgctgccctgcaggccgaggaggttcttggcaaaggcagccttgaagccgtccaggcttccccagaccttgttgatctcggcgacgaggagcggagcgctgctggggtcggcatcgggcgaggaggagggggctaggttctcccagaagagggagtggttgatgtggccgccgccgttgaacttgatggcagcctggagggcaatctggccggcgatgtcattggaagcgacggcggaggcgtaggtcttgatggcgttgttgaggttggtgacgtaggcttggtggtgcttggaatggtgtagctccatgatctgggcagagatgctgggctccagagcctgggactctgttagcaagtctaacactgggcgatgggcatcacgaaacatatgttgcatgcatctcggggtctggctccaaaatgaggggattgtgtgcctttctcgtaggcggccggacttacatcgtaggcgtatggaagcgccgggagggagtaggtgccaacagacatggttgtgcggttgagtgtaaggtgtagagagatcaagaaagccttgggtacgacttatggggttggagcgggcagagaagagaaggttgaggctgtttgacgatgatgttcaggtgaagtaaagaggggtaagcaagaataaggaggggtaacggagacagcaaatgacgacatttggcaaatgctacctgtctcttgctgccagatctcggcatggcttgttagattggaaagctctcccggcgcgggttctcctacacgcggggcgctgataaatctactcttccaggagcaaccaatcagccagctgcgtgctcgcccacagtcattgcgtgacgtggctatcggtacctgagtcctcacaaagccgaaagctaatggactgcttagtttggcactctggctgtgctttgtgaacctgtatgagcaagtttgagaagagtggtggtggaaacatgctcatatgttgcccaatgcggaaattgagctagttgtgattgggcgggtggagacgaggcactgacggcggccatcaaggtgctcttagtcttttgatgtgttcgtagatgctcttagatcgatctcacggtctgtcattgtctttgctacgagctagattgaggaggaccgagcaagtttcagctcttgggcctcaaacgagcagaatcacatggtagctccagtcagccaaagaggagcattagattaagaagatgtacatagctgctctctcttcgatgaaccggtcaacattttagcaatttacttcctattacatcattcaaaggcacccatccatccatccattagcctcaacaccatgtgcggacctgagaccacgaatcgtcctcgcggaggagccctcgctgccctctcaccaccctcaactccagtctcccttccccgtagcacgctctatggcgacttggccttccatacccccggaaatcccggcagcgcgaacgctacacacgccaggctcacaccagaagaggcctgccaccacacagctctgtccgacctctgcgtcgtgatccagtgagtcgaagcaccttgtcccgcatgcgacagtacaagactaacggtgacaactgtagttcatccggtgaccttacgcgtaacccagaagactgcggtctgttccgccagttcacgatacccgccaagctcacatctcaaaacggtgaatactacgagctcgcgctggagagcccgctctccctcgccgtgggcagcgacggcatcattggcaggcgcgtctccctgtgctcgggctccagcctggatcgggacaacatcgttgctgagggaatcgtcggcttcaacttcatgaggccagtgcagccgaccctttgattgggggtctgccacggcatgcatgtgacgtgggctctgtacgaatataatactatccagcgatgcgtcacccgagtcactgtgattcagggcagatatcacagatatctgtgattactgcgtctcaccgtatttctttcagaaggcagtgagcaacatcacccttcacggcgcctagctcggcaaaattcaatggcaaaccgccccgtgtgctaagctatgcttacgggccagccagctcttgttagcaagggatgagacttcatggagagctcgggttttccaacacacaagggaaatgtagcacgtggggaagaaagacacctgctaaggtaccaataagcccgtcaggcactggaagctcgaggccttggtttttgcaatatagataatgaataataaatgaaaaagccagctgaaaggctacgatctcggccgtcaaggtctcatctaatgtcggctcttgcgcaaaccccatctcacaatgtgacaacaaggcgtagcaagtagcaccgcacaatcataatctgggtcaggggcaaagtacttttcttttgacaccctacgcctcagatcgcttgttctctatggcgctgaaacaagtaacaatgtctgtttatatcatgtcacatcatacattcgtatcggtcgttatacgtttcgttcgtcccattccacccacttccggatgatgccatccaccttcctgaccgcggcgcgtgtcgcctccacctggaaccactcgcggtgctcacgcccgcatgcatcacacacccctagatcagctcgcagccccatccccgccagctcgatgtggatgagacgttcgacccggtgcgcgtgcggcgtggggcgcggcgacgttacgctgcctgaggctgagggcgagtacgggtagtaccgcaggacctcgacgtcgcggccgcactgccgctgccactggaccatccggcggtgaacgttggccgcccggcctatcttgagcaccatgggcttcccgcctgcgccaggagctgccttggattcgttcttatccgcgtacgagtataccacgtcactggctcgtcgagatcggggtgtcggggacgggggagcgagcaggtcacgggctgcgtctccggggactgccatcgaccttgacgaagaggtgggcgtgagccagaacatgtagatgtagccagcttcctcggagtcgacgtacgggcgggcaagctctgtcatgagcgcagaggcggtcgtgggatcgagggtgtcgggtattaggtccttcgcctgactgacgaaggatgcccccgatttgcgggagctcttggatttcttctgtgcggaggggacagaggctgagttcttttggaccggtcgaggctgcggccggacaggcacagcaggtttggagggctcctcgacggtaccaaagcagcaacagaacgaggccttctgcttctggggtttcgtaggtcggcggccagagtcctgccgttggctcttgtgtgacttgcgtttcttatcttgcaagtcgatcagccccaggcggtcagcgagcgtatccaagctcgtgcgctggtgttggaggatgggtgtagcagttccacgcggaccaggactcgagtgcgccgacatgcttgcctgctccttgtgttgccagcagtatgagttctcatcgcgagggtcgggggtctggggccgtcgcttgccatgtcgtgacgggctgggttgggcgtttgggatcgctcgtcggcatggtctgccagatgtggttatgccgcgacatgtcgcgttaggattgagggagtctgagcggtcgaacgaggactcgggggtattcggtatgaagggcatcgtagagtatctcgaagaagaagcagggcgcgaggacacgatgggtgggcgcttagctgcttcacggtctcctttaacgaaggatggcgaccggtaccctcaacacgcgaaggtctagaaaacaaagaatttaaattgctacaaagagcagccaaaccctgacgaaccaaatgaagaagcgtggacccggcgcatctgccgccggcttggcagactccctggacatgaagtggcggtgttcacatcgtgactgggcttgttcctggaaaaaagcctggtggaggtccaacgcgcctgccgcagctcctgaccccaccaccagtcgctaaattaggccgcgcgcttctgctgtcaggcgctgcttgaaactcgcttgttcaccaacatcatgctatttaggtagctattgggaaacatcaaacatgtattccgatctgtttcgctggaaattacaaactgggcacagatacttgctgcaaccgtccgtcactctcgcacaaacagcccagccatgcccatccctgtcccgacgcacatactcaccactcccacctcaccacctgttcgcccaaggccgtgaatcagagtactcgtcattcttgctcccgtcgcaccaagcgggtgacccagggcaatcgctcctccatccggattgaccttgccatcctccagtgccttctctagccccaaagcacgcacgcagtacaccgcctggctggcaaacgcctcgttgatctcccatcgatccacgtccttggcctccagtccatgttgctccaagagcttgggaatggccagcgcaggcccgatgcccatctcgtctggggcacagcccaccgtcgtggccgacacaaactttccgaggatcggcagtcccaactctgtggctgtgctcctcttcatcagcagggtggcggcagctccgtccgagacttgtgatgagttgcctgctgtgctggttccgtccgtcatgaaggccggcttgagctttgcgagagcctctgggctgatgttggcccggataccgtcgtcttgggtgacggtgattatctgctgctcgccgatcttctctcccgtctttttgtccacctcctggaatcgagttgtgacagggacgatctcggcattgaacgcgccagcctccctcgctctggcagccttgatgtgactctggagggctagagcgtcctggtcctctcgagaaacgccgtatctggaagccacgttttccgatgtcaaccccatagccatgatgcagtcccttgcatccttaaccggggagtccttcaattcaggccataaatcaacaggaatggccctgctaccgtagtttcgtgacatgctctccataccagctccaatacccacagcgatggcgccagtcttgatctgggctgccaccaagttaatcgcttgtagtgacgatgagcatgccctgttgacggtgtaaagcgacgtagtgttggggtaaccgacgtgattcatcgccattctagctgcctttgagccacccagctccgacaaaacaacgccgactgctacatcttcgatcttggctgcgtcaagctgaggggtcttgtcaagtgtcgcgcgaagaacgacagagaggagctcttccgggaatgcatccttgaacttgcccttggctcgtgcaactggcgtgcgcagcgaagacacaatcacggtgtcggtcgccgccttcttcaccaccgatgagagtccgcgcggcagagacattttctttcctcaggtatttcctcaggtacgacgtgccaaaatgaagtccaagaacaataattgtgatgatggatcagagagaagcgagtgaaatcaattcaacgcccagccgagcatcgggatgtaactgtggggaagtgaatctagatggacccctctcccgagccgaactgagcaacaaggcctttgtggtttcttctcttggtctaccggattttcagtgcggcaacaatccggtaggtcgtggcaacagtccggcttccaaaaatggctgagtctcggcgcgaacgaggcgattctcgcaccgctagaccaatgaaacagcggaccgcccagcctcgtcgggaaaggcacctcgcagcgaaccgaaccctgattcatgccgcggtcgcctgccggaagcagcgctccaccagccggatgctgctcaagatgcaggggccggttgcgagtcctgtctccgatgtaggaacggtgagcgagtgatgtcgagattcttatcaatcgtctgatgttcgaatggtgctctgttttgctgcctgtccatactgtatctgtcgcggccttgatcgtcaaggtagtccatctccatccctttgacgtctctcttccatttactacacacaatggctccccgaatgctctggccgagggccttaaaagcctcatgcaagtatggctcaaatgtaagttcaagatgtacaatctgaataaagcatcgaccaatttcaatgttttccatgtgactaactcatccagcctgcgctcctgctggccaggaccttctcggccacagccaggcgggcagagatcaacaaagtctacccctctgcaaccgaggccctgaaagacatgaagggcgacagcactctcctctgtggtggattcggcctctgcggtgtgccagatacgctcatcaacgaggtcgccaagaaggggatcaaggggatcacagccgcttcaaacaatgcgggcaccgataacagcggtctaggcaagctcctcaagtctgggcagatcaaaaagatgatcgcctcctatattggagagaataagacctttgagagcatgtatctgaatggacaggtcgagctggagctcacgccccaaggaacgcttgcagagaggtgcgccgctggtggcaaaggcatcccggcattctacacgcccgctgcctacggcaccgtcgttcaaaccggcgagctgcccgtgcgacacaagcccgacggtacgcctgagctctataaccctccaaaggacgtcaaggtgttcaatggaaaatcctacctgctggaacacagcatcgcgggagactacgccttcgtcaaggcataccgcgccgacaagctcggtaactgccagttccgcctcgctgcccagaacttcaacggtgccatgggtcgtaatgccaagatgactatcgtggaagcggaggagattgtcgagccgggagagattccacccgaggcggttcatctcccaggtatctacgtcaagcgtgtcatcaagagcacggcggagaagggcattgagaagtacacattcgcacaggaccccaacgatcctgactcaaaagcgaagagcgccctggggactggtgagactgcagcaaagcgagaacgcatcgttcgtcgcgcagccaaggagttcaagaatggcatgtatgctaacctgggaatcggtatgcctatgctcgcgcccagcttcgtcgggcccgaggttgaagtccagctacagagtgaaaatgggattctgggacttggaccctatcctcaacgtggccaagaagacgccgacctaatcaacgcgggcaaggaaacggtcacattgaagccgggcgcatctgtctttggctccgaggagagctttggcatgatcagaagcggcaggattgacttgactatcctcggcgcgatgcaagtcagtgcccggggtgatctagcgaactggatgctccctggaaaggtcaagggcttcggaggtgcgatggatttggtaagtaacccttccaagacgaaggtcgtggtcaccatggagcacacggataagaagggcaacccgaagatcttgaagcaatgcgcgttccctctgaccgggaaggcatgtgtttcgagaatcattactgaacttgtaagtcgagaactctacgctcctggacaccaagctcgtcttttcattccggtgactaatggactgtttctaggccgtttttgacgtggactttgctcatgggctgacccttatcgaaattgcggacggtgtgactgtggatgaagtgaaggccaagaccgaggctccctttgctgtagcagaggacctgaagcctatgctttgaatgaattagtgacgaacattgataaatggttaataaaattgtatcaacctgtgtcaaatgcgatcagtattccgccacattgatgtctacaactcaagtctaaaagcttccgtactccatccactagaatgcacgtccaaatcaaacaaacaacaacttcctgtagttacagtcaacttggtttctattgtgatgacccggatttacatttacaccaagacataggcccggaaagcgttcggctgtagtcggatagtgcaccacgcgtcggctatgcgctgtcgggtgcgtaccatgaagctgaccctcttccgccatcgattcctagaccttatgacactaccggcttagatactaaggcaggattggaaactatgcagactctttcctatttccccgagtacttaatgatccagatttttttaggaggaccacaaaggcaacatgtgtgagggattggttgggcgagtatcgtggccagcactgtaacgctcgtgcccgctccaccttttacggtggtgatttggcctttgggcggtgttacacggccaccttcacagcaaattcggccgcagagcaaatccggcaaacaaacaatttactatttaattaatttaagagctagttaataataatatgcgagaaatcaaactgcactttacataccttctataatcgaattggtatctggccgaatttgctgtaaatagtggccgggtttgctgtaaatagtggtcggatttgctgcaacaccacccaacggcagggagtgagtataactcgagcctaacgccatatcctattaacatcctaaagtggttatttggcatttatttccatcgactatgttgaagcaagttttctaaaacgctatatattcagtagtagtattgctaacaatggcgcgagttgttgggccctgagtaggttcatataccgccctgattaagcaccgctccatcgaattcgtttttggtgcagtggcttaattcaacacgagtccatctattcttcttgcctcaaggttagctccactactaataagttgtggttctaattctgttgagaataatgatgttgttgctgctatcagcaatggtgtattgccataactatcatcagcacccatgctggctcctttcattgataagtgtctttagaatgggtctaacattttcattactgtgtttaattacgaactcgaactctttaaccgcccttacaatattcaagtttcccccttctgcagctttaattataatcaatggtattcggccatgcttatcagtagccacgaatttcactcccttgttgatgagctcaaatatatgaaagtctctgcccgatcgtgacataatacccactagtaatggtgtacggtctgccttatgaatagcctcaatgtttgcccctttattgataagtaattgagcctcgcgattattcgtttcttctgctgctacgatccgtggtgtgtgtgtggtcattattatcagtgccttcgatgctggctcctctattcacaagttaggtgacaacttttgctaccgctgccactaatgatgacggtatagctgttgtttccgttaatagtgtccagctttttacctctaccatgagtagtgtacatccgttactatctatagcatgaatattggaccctttttagatgagtttcccgacgtattccggcacccaggtcacccaatacatctattataaatcgtgcaggctacagtgctccgtgacagaagcatgctactagtgttgtatatcttcaattcaaattatatcacatctttcgggcgtgactgcggagtaggaggatgtcagcatactgatatttttatgcattattgagcgaatgtgaagatgatgaggggtggtataggtaacgaatggcaaccacggagcgaatgccaggtcggctccctcagtaccaccagagagaagagatatacgatagttaatgatgaaaaactaatttagattcttaagctgctggtcgggagtttgaggagtgccgagtcaagccgttatcataggctccggatgtacggatatatgagttgacgagttgtggcatgattgttatccattttcgcacacgtgtactgaattcagttttactgatctttaatgagaatcaataaattttccaatgacaacaatcgggaagtggcatctggaaacagatcaacatatgtgtcccatagcttggatttgtaagcaaccatatcggtttgaggcgaccatccgctgcaaaatcccagagccaaatcgcgtataatagacttgtctcaattattttacggcccgttgtgagaaaaataagtctattactaatcctataacaagatggggccacgtggaataatccttcaaataccggtgactccgtataacccgcctcctctacccttcctttcgtcccagctccgcagcctcgaagacatacacattcttcatcatcccccaagaacaacaacaaaatgagcactgctaagcaagggtcaacattttggctgagcataactggtctgctctgctccatcttcttcctggccggccaatactatgcaggcggcccaacatcgccatccacaccattcctcgacttcgttaaagctcgccgcacatactatgctttgaacgacgcactcccatttggcaaagaaacagttgttgaaattgttcaggacttagtccaagatgtgcccagcgccttcaactctcaatccaatcgtgtcgtgattctcttcgaccaggagcacggcaagttttgggatactgtcagccgcactctgaaaaacgtcgtagctgaggatcaatgggagtcaacaagcgaccgtattgccactttcaaggctgctgcaggatcagtaagttcgagcctgctatgaacgcaatatcccataagagctgtcacagtacatgtatgttagctaacatatgaaccaaacaggtcctctttttcgtagatgaggcagtagttcaggaatttgccgccaacattcctgcatacgcagatgaattcccagcttgggctaccgagtcaggtggcatgctgcaacactctgcctggacagccctggaggccaaaggccttggtgccaacctccagcattacaacctcgtcaatgaggagatcgccaagacatggaaccttcctgctacctggcggctcaagtctcaactcgtctttggtggacgaactggtgagccaggtgagaagactttcaaaccactgagcgagaaactcaaggtatttggcgcataagttgggcggcgtatcatgttgtaccactaaagtggtgaagaggatgtcaacgaatggacaaagaagagatatgtttagtccacaaacaacgcctgcaagataaaactgatccaggtgagacttgtacgatagttcctacctcgttcaatggactgctgtattaactcagattaattgcgttgagatgtcgggcctggcatcttctattgttgtttaactttatactcgaaccctctctctccgtattaactcagagggctcattaacaaagaaacgcggcatgacttccaagatccaagatccagaccaatgatcaatatcctgcttgtggaagctatcattagcgagtcgcccctttaagcttaccccaagagtcatgttagttcagcgctattatttgtgagatccggtgattaccgagcatgtgcaatctgtagccttacaccctcgatcccctgaaaccattattagattttgtatatgttggttttagtttcgttggaagagcataggatcgattccgcttaatgcctcttcgaaattgtgcttaattcacactcaaatgggtaatgaggttataatcccgctgagctggaagatgttctgctgagctcacaaaccatcaagttgaagggggctaccctatacagctgctgttcaactgacatgcattgcattatcattcgtcgttcaaataagtaaagtagattatagcttaaaatattaaaataaactatgagatcggcataaataagagaagagcggattttcgacttagacaagtttcctcttgattttttagggaggaagcccagccgatgatatagagcacactgcctgggatggagtcctcaaggttgggtgggtcggtggctgtgggcatgcacgtgagatttccccagacttcgcccgtcgggaacggcaggggttgtggatgaggccgacctcgttttcacacatcaacaacaattgatacattgctgagattaaccaccgcttcctgtattacgcccctggtacctcagccctcccagtggaagctctaacctgtggctgtgtggcggggcgcgcctcacgcgcgtcgagtatttcttgccttggaaatatctcgtggtggcatactaccgatcgccggcgcccagcacatctcgcgatgccgcgccctaagttgctctcgagtcagcgccaaagagctgctgaggcttgcaatgcttgtcgagaggcaaagaagcgatgctcgggcacggcaccttgtactcactgcctgcgtcgcgggctgggcagttcgtgtttcatctcccaccgtccccgggggaatcgccattctgtaggtatcgggacgggactatcaaattcgaagccgacgaacgggggccagcaacctcttgcgacaagcccaccaagcactagacatagcaccggtgctacggtttcagacttaacaaccttctccgccttcgaggacacgtccatgctcagtcattctacggcccctgttgtgcctggtggaattgcttcaatatcaccctcggaggctcgtacgatagaggttgacaattcttcaacgattgtcaatgtagagcctccggtacaggttatgagtgatgtggacgactctagcgccttgtcgttactttcaatgaagccgtcccctcgcatgttgctgaacctgcgtggcgagcgaggtatgaactaaacttttcacctaaaatcttacgtgaatgctgaatttatttttagtctacataggaggaggaggctctctctcattcctgcaggccgttcggggtattatatctgctcaagttggaccctcgcaattttctcgtcatggcaaaagcgataccatgttggagaaggagtcgccgcaaacaagagctcaagtttccagtcctagtgaaatgaagatggaggataagctcatgtatgcaaaatatttctatgaagtggtaagtactgctatctattgtggtatgcatgccgtttactaagcgtttgacagaccgggggtttgatagaccctttctgtccacaagagatggagcagctcctcacgacctctggtggagggagtccccagaaaagagcgcttgtacagctcattattgctgttggccttcagtgtgatccatcggctgatgcctatgaccgcgagctggcgtattttagcgaggcccaggcccaagccttttctgggatgcttgaagacccagatattgatatggtcagaatatttttaatcatgtccttttatctcctgggggaatgtcgcaggaacacggctttcatgtatcttggaattgctgcgagagccgcgctgtcactagggttgcatagccctgagacctatacagacatgaaagattcaaaacaccaacttaggtactccccaaccctcctatttattgcaaaagctgtcaaactgattcttcgggttaggctgagagtatggatgagtcttagagtcatggacattcccatcagctctattttaggccgtccacctgcgactgcaggagtccagtctgatttacaaggccttgttgatgatgtagttgcctcatctcaggaccggggaatgatctgccttgttgcgtcctacaaaatggtatcgctaataagcaatatcgtcgagaaactctatgatcgtaaagagatctctattcccatgatagaagagaatctacaagaacttgagaagtggagtcagggcctccctcaattcctccgcacttcgccttcacagacggatctcgccgattccgacgccgagaagagcgcaattggacgcgtccatgtatcttgtctttattattttgccgtcaccctggtaactcggcccatactggtgtctactctgatccaaccgcaaattggaggaatggtacactctcatttagcatctgcgtgtcttgatgctgccatatttatcgtccagacgtgttctggggctaggaagcttggtttgttgaaggcaaacatggcaaccataatgtaagcggctatttcaaaaacttttcgggatagcctctgactgacctgttacagatcaattatcttcccagctggtctggtactcgggttccaaatttttgccaaggacgttgtcgattatggtatcgaatccgcgtttcatggcgctagagaactgctcaacttcctgggagccaagagctctcaggcaaccttgtactacgatattctaacctcgctttccaacgtgattaatgaacgccgcgagaaatcatccacgaagagtagaactgcttatgtgtcaaagttattcaactttgaacgacagcaacctgaggggcaggcgagagatgcgaatcgtgcggcccagtctagcgaggatcaacagcccgtgcaaatgaatgacttatttgccacatgctctctggggaacaacacacctctggaatcaggggacatgtttcttgattgggacagccttgatatctccttgtgggagagctttccttatttgacttgatatctatgacgaagagaagaagcatcagggcagcgacctggtgtaaataacatcagaatttttcagaactactattaagtggctgtggtgctgataccataaaatgtaccctctcagggtcttacgcgagaataatggaccgaatccaaacacatccggcatcgggcagaattgccactgaggcggtctctagctgtactctgtgtaatgatgtacggctcccctggcggcgataattcgaaatggccaggttgacctcaacactacgatcggccaaatgagcaaaatacggctgcgaggccccgaataatggaataatcgatcaagatgagtctggctcagtagatggtatttattttggcctcatgatatgatcagatgacccaggattggcgtgtagaatgtgtgagcaaatgcttggcggtcgcagcgcgagatgatgccgagtccaaaaagccggccaggtggtgattctctcgcctagggctgacaatgatatggcccagattggcaatccccggacctggcagagcttggcacgtcttggttcgcaattgagattggtggacttgcgagcacgacccaagtcatccgaatattgacagggaagcccctctaagctggggcaatgttgtggctcagccttcccatcgcaaaggctgatgtcattagcaatttgacttgctgcccttgcatagaacggccagagaacgatcccagagaaggggatggttataagaagggcgtgtgggcctcgctatattctgttgtccggtatacgattacgatccagccactcatcgaagccgtcaacatgaacttctcaagccatctacccactctcttgagcctggtctgcgggttagtagccacggcaaacgcacttcccttggacaaggatgcagtctctgagcactccacgcgtggtacctcatcaggccgcaatggctggacgaaacccatcccaacttggaccatcgtcggtattgtggtatccgttggtttcgtcctctccgtcatcatgctctggtgctgtaagcgacaaagggcagctgcaccgctagcatatctacctcctaccacaacacagccgtcagcactgccaacggcgacagtacagccgactaattcatttcccgtggttcaggagcctcctccggcctacaccccaagagatacttcaggcggcgtctgccgatagatgagagcgagagtccagctctgataaggcagtcattaaacactactgccgacatattttttctctacggggacatcaacttgcgctgaggatgcccatcaatttctacaccaccacatcagcatgcaagtgctcctgtgaatcccaccaccttgcttagagatgcaaaaggtgcttcgcgttgacgaaaggctccactcagcaggctcagttgccgcatatgagtcaaagagcggatcggatggtgtcggagggcgatgtatgcctttcaccatatcacgagcgcgctgttgcccaaccccgctacctgggcgactctcgagacacaatcttcttcaattttgtgtcataagtcgcccaactacttggcaacaaatcccagccctgtctagttagttcatcctgggcaatcttccgtggttattattttggccacgggaagatctatgacaagcaaaggagacttggttcaaatacttgaacactaaggcgtacttattgcttctgtatcgtattcagtacatatctcaatgtaacttcccaacttatattttccttttaccatgtgaagcatatagatccacagcatgaatatacagaaactaccttattcacaagtatagctctcccaatcatctacatttcccccttctttcagcttcgcaccctggggccatgtacaaagtttcctggtcctctcatctccattcgtcggaccccagctcttgataccctcaactggctcttgccccttttctatccaatctaccattgcggaagagaacccgtagtgcgcgggcacataaggatacttggctatgtttgcgccacagtgcccgcccccaggcaccatgacgagcttgacaaaatcgttctccgctatggtagttccgggcccaatggtatcttgcgtgatggcttcaacgtgttggattgaccactctggggcgatatttggatctgcccagccggcaaacacgatcatcttcccgccgcggtcgcggaaggatgatagatctgttttgatcgaattgatcagcccgccggctcgttcctccacaacctccacgtcggatccccagttgaatgtcgccggatcatacgccaggtcgtcgtataccaagttttgaagaattggcacggcgaatacataggagaggaggccctgtactattggaagcgaccagccagcctcggaaccgagggtgacacctggccagagggacttgctgggatcatccgaacgcacaggtccttggtaaatcgcctttacagcggagagctggtcaggcgtgagacacgtgacgttcccagcagaagaaccttctgaacaggctaaagaggagatgttgaaggggcaggcgagcgggttttcgacaaggttgtctgctacgccgtcgatgaggtcacattcgctgatcacgctcgcttggataaactccaaaacagagtcggaaagaaacgttgcgttagtctgtcatacgaattgagtaagcagcgcacaaggaggaatcagatgggtaaacctacacttgcttgttgagagttccagaggaagcccagtataagacgggtaaaccaatttgcagggcaccctgcaataactccgtcaaagaggtcggggtggaattcagcgagcgaaaacccctgcgcaccaccggcggagcagcccctgtagtaggagtgctctggctgatccccgtaggagattttgatcagctccttcgcaggcggtgtgattaggctaatggcattatgcagccaggctttcacttggtcctcgtcatgaaggaacggctgataaacgccaggcgcgccgagaccgacgccagtaccggcgtcgttgtctgaggccaagtggccggcattgccaccggctacagcgaagcccagcccgctattcaactcttccatcatgtcggtgtaggggatgattcctccctggccaccgttgccaactgccataaaccgcgaggagtactgctcgtcgggcagccagagtgcgaagattatggtatcgttcgtgccataactgacagaagtataaacttcgcaaaaggggaccgcattcacagtccccgattcattcagttctccggtggcatagtgggtggagttgaggatagtggcattgtatgatgataggtccactgaaagcccgaaagacgagcaattgaaagaagcacagcgtgcgagggtcgccaggctcagggcgttgaccgcaagaagtaaaggacgattgcaagagagcataatgagctatctaaaatgttgttgtatgacaacattaagacattaggatagaaaaggcgcatagaaagcctcactgacttctacgaaggacttttatatcaacaagaactaggctcggatgatagaaacccccgaatcggccatttttaaagcgtcgagtagtctaatttcaatgaaacaacattcccgacagatgacaggctattgtatctgatattccgagatcaacatcctggtgcccctgtccggtttaggaaacacggaatcgatgtctaagctaaatctatcagttatgttcccattactagccaaaagttcctttcttaccaggaagacggctaaatgtgcgttgagcaagtttaagcaagtttctccaaaacgggcattactgggcgttacaggtttgtttcaggcgtgtaggatacttatgactactcaaggggattcggtggagtgttgagatcctacagtaaaatcaaacagggattagtgtggaagcccggcatgataaattgggcaattggctttgcagtccccttagagttttcgaataaagtgagtcaacagggatcagcgtaatgcactaagaacaaggatagtattaacgtccacacagacatggataacacaattcttctaagtcagaggtctaaaacactcaaataggtgttcatcacttctctcttgattgaagttgtacttgcacatgtgctaccctgtctcttcccttgacgagactactgtttctagataggcgtgctggtaagctatcttgaaaggagtatatactttaaaggttcccttattatcaatctagacaatttgctaccagctgccagataagtacgtggtccaaagattctgcttcaatcagtccaagtcgtacaccctctcgggtcacggtttcgacaatatcttcttctaagctatgatgcgttggaatccaatctaaatatttctgggctctgttcgagccccctcgggagttagttccgtacaaaatcgtaccagggaaacccgcgtgatggcttagaagttggttaaattgatcctctttcataacttcaactgatgcatcgggaagaagcccaagatcaaaggcggctgccgcaatccgtctggatatgtcattaaaggtccacaaagaagtgtatgttagctgtcgagcgataatttgcttgtcaaatctggggcagaaaaacgagacgtaccaactctccgactccagtgagataaattccgtcttggccccacacattcttatccgtgtgtctttctacggccttttcaacaagtcgaaggatcatctcgccgagatcgcgaatatgaatatttccccatcggtttacaccagggccaagtctgaaggctcgacgccgcttgaggcttgcctcaacaagatcagggatctggacgcttctctgattgactggccctcgtcctgacccatagatgataggcgggtagacgacagctattttgatgtagctggaactctgtgcaacggacatcatgtagttatcaacagctcgggtggggttgctccttataatggatttgattgcctcaatgccatccagatcatcccaaatgatgtcgctttcggtgcccggttcccaatttgggtctgtgatctcggtggaaactactgcggcacctcccgacatttgaatccagtaagggggcttttcaccacggtaaagcttacttagtagaccgcgatgaattgctttcacgctcttcacatggcttgatgaagctaagtctgccccgaaagtcagcgagaatgatttgtatgatggtgtagcagcaattactgagaacgatatccgcttgcatggcctctttttcaagaatgccctcatcatccagagtgccttgcacgacttgtacgttgtttgaaaatcgactgatagtttcaatctgggccgtattcctgacgagcgccgtcacgccgtattcaggatgccgcttggcaatgaggtaaagaaggtcgccaccaatatagcccgaggcaccggttctaggtattttgcagttagctctagccaaagagaaggagcgtgggaaatggattgattacaggagtatctttgtcatactatcgacaatattatcagatttgctgttacaataagccaagctacgctacggacgtctcctgaatttgtagtgcgctgccatatggtgggactcagaagtatcaagccacaaacccagggcgatgcagccttttattctctttcgaaaactttaatatgattaattggaagaactgataaatagatttctaagaccataacataatacgtgagcactcgttaagtacagggcctggggagctccgttccctggcatgcttgattgacctggacccgctccgtggaattccgtcttcgtctccgtctccgttttcgcttggtcagtgttgtggcagcaatgcaacactacttgttttcatgatgaccaagagcaaggaaaggaaaaacgctaaaggacacgcgcttagttgaattgaccgtcgacaagtttttgataattcgggaggtttatttgaatctagctatcccccatgtcttctagaaaccacatatcgttcgcttgtaaaacccggttgacttgcccccttgcccgtctatctaaatcttgcgcaagttgcaggagaaagaatttgttctctgatgagccctcgctaagcttttcaaacagctcccgtgttcgatcgatcaagttttgatcaacagaaaggaattcatgatctggattctcgatgatgttgaccagcagcactattagagccgatagctcacaacacgtatgaatcctggtgagtttaatcagtcagatatgaagcgacaaaaaccgattgtgaggatacgtaccgcatagcatgctctgtctctttccccatggccagtaattctagacaaagtcggcagtacttcacgcactcttcccatcctattggaaggggtgcgaggttacaatgcaccacttcgctatccatgtcgtctcggagctcgatgacgcagggtgacaagtagcatcggaccctgttgagccatgctagttcaaaggagtacatcgaatgaagtctgaagatgcactccaggtgccgattgagcaagttagtcatcaactggaaagctccatcgttcagtcgtcggcgcaagccatcagcagtcagcaggccatcgggaattgactctcgccatgttcgaagcatgtcatctatgcgcgaaatgctgtgtaatttctgatcctctgacagcttacgagctcgcttgctatacaagagatcgtggatctttccttggatattggcaagctccacacgagcacgaagatagttgaatcggagtccatctatcttagatgtcactatgcctagcccatcctcgctatcctcggggaattcgagatccatctctgcatcgatctgagtatacggtgctttcgctcgaagtgccaaatcctggcgatgagttgttagtatgcaatatcagtctcagaagcatctatcaaaccatgtagctgaccttgtcaagaatatacgcaatccaaaatatacgccgcttttgtagagcaacactaggtggaagcccttcaaagcttctctgtgaaggcaaacccatactttgaataagccgtatgcagcttccgataagaacaattgctagctgagggctggttgccccctggaagagtgttaccatgcccaacaaaacttgcaaacccagaaggtccttgtcccatgccataagatcagttgttgctgactggacaatctgaatacttcgtgctagtgctgggtcgtctaaggatctgtcttccaacagtcgataactgatcgcaagaaccaagttgagtgccgcccatggaactatctcccgcgagtggggggatgaatatatttctagaatcatgcgcataaaattcggttggtcgaataacggagtgtgtcggttgtaggcattgaaatagttgtccaccaccggaagcagctcagttaagggcgggagatctaactgtccacatgttgcagttgatatccccgaagtggcgcaaatattctttgctatactcatgcatggcatactagagctttcatgccacatatccggcgattggtatgagtttacttctggcagatcactgaaccgtacatgatgaccggacgagactggggcaatatgttgctgcagcgtggcatgtgctgcctcagaattggaaacgagttgggccagctgtgactctattttagaaagtcgagattccagtgatacctccctggtcacagtttgtcagaagtctagaatatcattttccccgactggccaggagacggagtggaggcctacgtttgtgatggagactctgccggcgccgtggcaggatactggccgtggtgatgactatctggtgcccttcgcctgcccgctttggttgtgatggtcattcggcactcggcgccataggtaaggcaatttgtgcatacgggcttgagcgaatcgcatctgatcttccgcgaaacgcagaaatcgcaagctatcgatccacatattcttcagtgaggagagccttgcgaaaattatcagatgattatcccccacctttgcgtctgcgaacaggattatagccgtccatgaaatggaaagtttcaatgtgatgaaatttgttgatgaaccgtacaaatcgtgcaatcgtccctcttgagctcaaatccaccctctttcgtattattaatcggactgggacatgattagtcagttgcggatagccatgatattacacccccaaccgtgtatagactacaaatgtacgcatcttgaattgagggaaataacatttattcggccaaagcagctattctaggcgtttagaatcacagtgttgttagagaagcgcattgaacacccggtggtagtctcagtagggaggatcatcggaggaaggatcatcaggagcaagttcagcaggtatctttatgaggcgttgttttttggccttcttcttattccttatcgatggtttcggatgattccatgaagaagcatcggggatgtgtgaactccgagggtaaaatcgactcatatattctgaggcaacaacgtcagcaagtttctctacaggatcgtaatcattattctaaggtatcaggttcaatcaccttcgtcaattggtcttggtggttcaataggtgtcgtttcgtcgaatggtactggctcgtatggtgctgggcttttaattggtactcgtggttcaattggcatcctctcttcaattggcactggttcctcgattggtactggttcttcaattggcatcgctgcttcaattggcatagcttcttcagtgtctgcctcctcggctcgtggctcttcagccgctgccgtgtcgctacccacagctgcaaagtcgacggttattgacgtttgagccggtggctcttcactttctcccgcttctgtgccgcagatgtcgttaattaccatacctccagcttgtgcactttcaatttcaaccatacctggagcgacttgcagctgaaggatacatctgaggagaacttcgcttgcagatgtcggttcagcgagctcatccgagaggacccagctactgtcgctgctagaactcttgacgagcctcttaacgcgcaatgagaggtatgctgccacctccgggacatttataggtgacggcctcaaggcttcgattgcccgaatgatagaggtcagcttcaactgatttccaactacttctaattgctctttggcaagaagggagagtgcgggtaactcgagggttttggcggcgctacaagccaagagcgcggtgttgaattcgtccaggacctcatcattggtttgtcgccttagtccaaggtattgatatttctttgtcagaagaaaatgaacaagtatatggccaacatcgattgggatgttatcaaaatcgaggcggccgttctttgggacgagcttggggctcgcatcaagtagcttcctgtgaacataaattggaccttcgtctccaaagaatagggcggatgctttgctggagtaagggctgcgatcaagtcaatacagcaatcttccagtggatagtcagtccaatgagtactaacgattgaagtggctctgacgacgcccaatcccgtgcatccaacccatagcttctctcatcgctagccattgtcgtgagtgcctaaggagatagatcggttttccaaatcagaggggcaacgctgaaaggtacttaaaggaacccgcaggctgagaggcagaagggttctttattccctcacgaagagaggtcccctgatgcccaatattcacatgcgcgaaccgtaagatgcaagtaagcctgtgatgtaacatgagcaaccaattattgacatctgctggaccctcagaaccagcagcacgggaaatgcaacagcaaatctggtagctgacgcctcaaattcaatgattgggtagaaatgaaccacccgaccattatataacgccaccaactgctcaaggtaacgtcagaagggggggaagtctggaatcaccaatcatctcgttcggccaattggccatacatggacagctgcagtgcttagtcccttttgacgaatgacataaacttatggtatttacttaattaaagacattgcttatgagcttgagctcgccagtgtaatattatactccacctcccaagacgcctcggggtccccagtgcgaggcttgaattccaccgacaactcgtccttgacagcgaagacggtatcatttcccaggtaagtgcagtccttgtcgaaaatctgagtgacaagcggcttgtatccttcagatcgaacctggaagaaccgtatcagcggtgaagtcttaagcagttatgctatgcaatcacttacatataaatgaatatgtgcgggacggtagaaatggcgatccatcatgcgaagcattttaccggctgggccatcttcagggatctagaattctggttagaacacgttcatgttcaatgtgatcgaaccttgaggcttacaggatatggggttggtcggaggcagtagtaggagtagcggccttcggcgtcggtaataaaccttccacggagatttaagtcttcttgctccgggtcttgttgctcgtatagacctaaatttcgaccatatgattagacaattaagtcatcacagcagatggttctcggccttaccgttggtggaggcttgccagacgtcgatgctagaattggcaaggggtttgcccgtaaccgcgtcggttactcgaccgtacataaaagcaggcttggcgtctttaggagtgttgaagctgatggtggtgccattcttgcgcacagggtgatcgtgtctgtagaagggacccaggatagcggatgccgtgagtccgttgacgctctttgtcgccgcagtataagtgatatcatccacaagactagtttgcggatatcaataaaaatggcttggacgctcttatttggtgagactcacgtttctaatccgatgacatcgcacatgagctgtgactcgttgcgcttctcattgctcatctggcccgcccagttgatcatctccacgccgaggagccattcatcactcgtgagttgcacttcattggcaaaagcatgaatgtggcggataaaggaatccatgatctcgcggaggcggggaggcgtgttgggacccatagagtcaatcaccttttgggtgaactcgggcccaaggttgccaccgggttgagttgcctttgtgctcatcttgctgctagtctctgggtgcaggatcttgggatcaggatatctcgggtaagggagggaaacggattggaagtgttgacgtatagactagggcaagatggcgagaacagatttacgagcggaccagttattaatacctagacggacataggtcgaactctagcctgtagctcagacggaattgggaggacacacactgaacagcacgcggacaagggtcggctaccccaagtttttgcccacactccttcttgcccccgccaatatggccctctttatgcgggggacgctgtttgacattggatggaagtttgttagctggattcttgcggctgagagcaattggcgcagcgaatggagttggcggatgacccagtcagggacattgccgctatccgctgacacccgccagttccgctccgttcccgaaacgcccccattgtacgaggaatatgtgctaagataatcggatcccgggttttgatatctttgcccgggatccgaattgattattatgataagataattatgttatagaattcaaatcaatctaatcatatatccggctttccataaccgagtatgaacgcgttgaaacccgttctgagctggggaaacgaacctaccagaatgagaatgaaactatcactagaatgcatcaaaggaggagcggaatacgaaaaccccagtattgagaagcatgctagagatttgaactttgcatataaaaaggtactctagaaatactacccatgtcatagtagccgcacaagtcagaatattctagccttgcagcaattcaccacggtggtcaatataagctagttcggtattgtttcaggaagagtggcatttcaggtgtgggagaagttcagtaatagcctttattttccgctttacttatttctaaattaatagttccctctctatattctccggtcttcatcatggaagtcccaagatgcctcatccgctccgttcggtctactggctcgaaggaaactgatgtctagaccctcaatctcagccacaggtttaacggcagagacaggggcatcatatgccttggagtaccagtgatctagatattccggattctccacaaatttagggaagaccgttctcatctgcttgagggctgttcctgagatttgatccacgctgtgagcatgtctcaaggcaaggaagtcagggccaatctgctgacggagctcatcttgcacttccttaggcagcattcccaccttgaagagtagcatgtcgtattgtaggagggatgcttttccatgccaagaacctcctcgtacagttctatgaagaagacctgctagggcggtaatagcccccatgcaccccgttccgtagtcagatatgggaaacgggggtacgacgggctcgtcgagacccatgaaacggccctgctcccatgccactccgctcacctatagcactgtcagtaaattatcgcggcttctgaaagtagaaattgtcactcacgcaatcagcaatttgctgccatccagggcgatgtgcccattcccctgtgtacccgaagcagttttcgttgacgtatacaattcctttccctctcttcttcgcaagctcagtcatgaacttggccccgtatccaagcttgtcgagggctccgggacggtacccatcgaccacaatatcgacttcttgtacaagcttctcgaaggcctccctaccctctggggttttcaggtcgacatccgctgcatgtttccccatatttccatctacctgaaagaagggcacatcgctcaggtgcggactcgtaaccttgagcacatcagcaccgtactcacccaagattcgtgtaatgatgggtccagcaatgatgcggcacatctcaaggacttttatacccgaaagaaggcgcttgtcgtcggttttggggagtggtgtcggaggtgtctcagtctcaagactctccactgtccatggaagatggttgctgatagtttgtccctattttctcgttagcttcaatagattctgatataatgaagctatgaatcgtacgtggggagtctttaagaactcatcatgcttgtatgccttaacacccgcctggcggttctcggcattcagcttctccagttcagccaccgtgaatttctgaacagcaggttcgataaccccaacaatcttttcatgtgtgtctaaatctggccggtgagaaggcagtccgatcattccaagagttgttgaagcttccagagatccgtgaatatggtaatactctccaggctcagctgttgcgtaaaggttcgccgacatgcggcggtatccatttgactgagcttgaagtaaatcggtatcttggggacgaggttagcctacatatagcaaccaataagaaggttctgagcataagagcagcaatatacctttcagtagctttctaacatccttgtccagttttcccagcccgcctatcctggccaagtacgcttggaagaggaaggcagtcgtcttttcctggtccacaacaatggaccgggtcgaattctctccgtactttgaatccgcaagtgaagcagcaatgatgctttctacggctttcagggcagcagtcgtctccgtctccttgaaaggaatagggaagtaaggcctgtctcgctcccccgtaaattttacattttcctttttgcccagcgcggcatctgggatggagatgccatcgctcagtgtgtccagtagcacgtggaatatcctggagctctccgatatggagctatacttgtcctgcgtctctgtcatgtttgtcggctggggagtgtgctatgtgtgatctacacgggcacgggaagtcgggtcttcaataggtaggggtttgcttccaggctgggacaatggtctggatgtactaggattttacgttattggctcagagacgctgctaatgacgccggtgcttgatccacgcccacatccgcaagcggccccgccagtgagaatcctttccgccctccagccgaccggctttgacgccccgaaattatgccgcttccgtgtcggtcatcggaactgtcgtcccagattcatccattagggcgccaggtaacgtcatctgatggtacatcaacaaacggcgaggtgattgtgagtcgtaccctcaaagaatcttctcgcaagcagacgcaatgcctactctcagactccaagaccaagatgtctactacaggtggactcccgccagatccgaggaggggttcacatttgtattaattcatggcttgggctcctctcactcattttacgaaaccgtaacacctcatttgattgagagtgggcattcatgcctggctcttgatacgccaggtaagctatgtctctcgtgaatcggcctaatcctccatttggctttttgtcggcttacaactgtccttaggaagcgggctctccaagtatgccggtcgggaaagaaacccaggtgaaattgcaggcttaattgtagctctgatatctgagctcaagctaaattcccaccgcttcattgcggttggtcattccatgggtgccatggtagcatctgaattggctcttcaaatcccacacagcggcgttatcttgatcgggcccgttcacccaaccccagccctaggtgacatattcgcagctaggatacaaactatccaagagagtatgaattagaatctctccgtgtgatactagagatattatccattggctgacctcgaatctacagagggcttggaaagtctagcagactcaatccctaaagccgcgactggttcccagtccacaccgagccatcatgcatttatccgtgctttgctaagctctcagagccctgaaggctatatatctttgtgtcgcaccattgcaacagcctcacctcccgaatatggcaaaataaaagctccgttactcatacttgccggcggagaggacaaaacaagtccgctagcgggttgtcaggcgatcttggataggtacgtcaagccatgcaatattcccacggtggtcttttattaatgtcagctgtagctggggaacaaccagtgggaagaaaattgagatactcgatggggtcggtcattggcattgcatagaagcgccagatagagtgcagttagccatgagcaaattcgcagggtctctctcttaataaacgatatgagcagaatggaatcagtttacatttgtctttctcaatatcaagagaccttccaaatacaaacttgtgtgaatctgtgtagtaagcaacctcaatgggccatattaacataaggtaccattaagtactcggttgagcaaccgagagatatggacgatcaactgacagcggataagatttaccaagtgtctctatttagttctgggatagtatatgtctgatagaagacgattcgcgccaggcaaggactatccgctagttgtaagagacagctgaaagaagagcgactcaactcagatatcaattctcaaaaatcttgcctgggttcaacaaacaatgaggatccaaggtatgcttaagtgatctcatgatggcaattgtatcaggacccagctctttctctagacagtgcttttttccaatgccaataccgtgctctccagatacggtcccgtccatctcaagagccatatcgaccatatcatcgacacatttcttcactgacgccgtttgctttgcatctttaggatcgtacataaccgcctggtggaagttaccatcaccgacatgccccatgacactcgaaaacaggccaagttttgaagaattttctttcgaatggtcgatgatctctgccattcgtgatagcggaacggcaacatctgtcgaccagatctccgtgccctcttcacgcaaagcaagcatcgcccatagagcctgttttctcgctgcccatagactatccatctcctcttgcgacttggccacctcaaaatcagcccccccatgcgccttagaaatctcctgagcctgttccatgttgtctttcacagcgctctctgtgctccccgagaacttgatgaatagcgtcgctttctcggcccacattctcccacctgcgccgcccgtcttgttgataacttgcatttggacatcatccatgagctcaagagcggcaagtggaatccctcgccgaatcaactttgacgcagcagcagcggcttccttgacggaaggaaaagttgtcgtcgcaaccccgtatgacgaaggtatgacagcaagttttagagttacctctgtgatgattcccaaagttccctcagagccaacaaaaaggccggtgagattatagccagcagatgtcttccgagggcgccggcgagttttgataaccgaaccgtcggcaagcacgacggtaacattgaccacccagtctttcattgtgccatatcgcatggcattcgtcccgctgcagttggttgccaccatgcctccgatatgagctgttgggctcggatccaagggtaggaacagccctgattcttttatctggtcattcaagttcacccaattcacgcctggctggacgacgacatccatatcatctgcgtttaatgagacaatcctgttcatcttggagaggtcaatgctgagaccagtaaacggtgcagtgaaatggccctcaacactggatcctgcgccaaatggaatcatgggcaccttgtactttgtacagatcttagcaatggttgaaacctcttctgtcgtcgtcggcatgacgacggcgaatgggcgctcggggatattggaagctgaccattcagcgtagccatgagactcgagatcatcgggatccaggctgactgatatgcccttgatcgatactttgatctcctccagagcctgcgagcattagcatatgagacattatagtttgcctagcatggattgtattaagccttgtattctcaccttcaacgccgtcttttcatccgcgtatcctgggcccgctggacgcttgtagccacttctgcttgccacagactcggacagtgtttctgttcgttgagatatgatgcttgaagttaccaaagcagtaacagccgctgtagctgcaacgacgcccacaagaccaaacccattctgggcgcgtttggagtgtgcattggtagatggcgacgtactgtagcatcttctagcctttgagaagcctacacggcggccttgggagatggccaacagaccatgtgattgagggaaccttctcatgctggattcgcggaagcgacgcgtcgactgggcacagggcaattggttgtcagagtcggatattgtgatagagcacagatcaatgggggcggtctcctctccgtagtcgccaagccattgctccagcaggatctggggaatttaatgacctgaaaacggggccatagttgcgccagccaaaatcattttcggttaagtacccccgaccccgcggttagatccccgtcgtcggccattgttgttaccctacagtcattgcattgcttcaatatggcctcgagctggtcgacatatttgtttaccatctgaaacattatgccaaagaaggaagtttagagttttcataagattttggaggaatcgaaagcaatgagactgagcgaggagaaataaagaacatcgtaatgaactctgttgatttcgagctgactctactaacagctgatgatgttattcgtccaaaataaatgatctccgacctaagatgagagcgaactctagatatctaaacgaatctatcagcagattcaagcatccataattgaagctccttttacgtgcaaaagggcaaaaacagggttctgattcttcttcgcgatcattagactgggaacacttgcctgcgtatgtagggatcgcatcataggtatgtagaggagtgcaatttgaagagcttaagtggtgagctgtgctgaacccgaaacgatgaatacaaatgaggtcagattggagattgaaattggccagaaaacttatctcagaacatatcacgccctagcacacagacttcagttaagagactgacagagaccttaccatttcactagatacggcgacgtgcatgttcgtataggtccacatgctcagatctttctggattaggggcttatctgtccgtatcaatcgacttggggcatgtgattgtaagcagctgatggtttgtggcttgccaagatacttgcccgccgggatagatgatttatcatgtaacaatgatggcatatgtaaccgtgaaggatgaaggaagatgacaccgttgcgttctgattaaataggaaactatctgacttacttcgcgaacatatagaccaaaaggactgcgatcgcgcgtcgctacgtgggagttgggttgtgtcagccaaggtaatcttggaaaagatgggcatctccatattgagataacgggcatttccagcaatcagcatcttcccatcttgattttcatgcatgcaggtcgactcatctgcaaataatcctgcaagccacaatcatttgaccctccttgacgtggctccaaccgttcccagccaacgacagcaagcgaataggatccccccacatatctgcattatgcattgctcgaaacgcatgagaagcaagcggcacgttggaatcaaaagcggcatcatctctcctttacttgacccatttaaatccaagtcactgcctcggttcaggaggggagaaaatccacgctttcccatcgttcaaacgcgtcgacatctgcaactaagcaacgcgctgtgaaagaacttcgcatagaccccttattcgcttttgattttatttcattctttaagattctctcattagatctgtcaagatggcgaacgagacatttgttgactactacacggtccttgaggtctctcctgatgcggatcaagccgtcattcgggcgagctacatgcggctcgccaggttgaggcaccccgaccggaatctcgacaaccccgaagcaactcttcttttccagcttgtacggccttttcagctctcctctcccccgcctttcttagtgtatttgtggaatggtagctaatactcatcccaaccgatatagcttcagcaagcgtactccatcctaggcgatccccacagtcgccaaatcttcgaccgtgagcgtcggcgccagagctttttcggcggtcgaatgggcgccaggggcagaagtggcagaaaccatgctacattcggcttcgggcagacctcgttccgccagaccaacttaaacccaaccttcccgttccatgaaacggcagaggaggaggaacagaacagacagcgtcttcgggaggagatggccaagaggaggcaagaagagactgctagacgtgctgctgctgaacaagagaggctggccgctgaggccaatcgtgtccgtacaccacaggaggaagctgctcggaggcgcagattggaaagggaggcaaggatgaaagagtccggccagaggatccgggaggctgcgatgcgtgttagagaatcggcgctgaggttcaaagaggagagaaataggaaggctcaagaggaagcgctttggaatgcggaaagaaatgcctttgtcgaggctgagataagagttatggatcttgattgatcgacggttgctcatggtggcttggatgttatgagttaatggggtgggttttgtagagagtttttatttattgcctctgtttttacgtgattttagtctgatacttgcggtcatgactttaccaacagttcagccattgaacatgattatactgtatcaagactcgctcccggggacaatactttgcttgagaggcctcaatattagaagaatattcttgatagagcacgcaagtgtaaattgtaactggtatggatactgttcgtcctagaggtgactgcctcgattacgtattgttctacaaatatggtcgagtagcatcggagatagtgcaatcgtgtgagtttgtttcgcgatgagagcgatgagaaatctccctaaaagcccttctgaagattctatctagtaaatatcaagacgagtagattatgggtaaaaagataccacaacaaacgcttttaagccaagcgcaccagaaaatgaaacttggtggcaaccatgacttgttgaatatccgagtcaacagggagaaatacttgagaatagcctctgggggcacacgtattatttgaaatcggctagccctatgcttgattcatctattaacatgaacaattcgatttgcgtaaaccgggtcatactggctctctctaaacaagctccctcaagttcatttagttagaacttatttcttagcataggcagctgtagctccagtatcctaaagaaacgaatgaattagtccgaattccgaaacccttctaattctctcaaaagtttactcaccaagtatacttggtagaaagacatcctccattttccgtctgaggatgatttaacgacctgagctcttgccgcccactcgacttctgcctcaacaccattcttcaagcccaacgcaaccgagccatagagcataaactcattagtcccatttccgaaagggaaaatcttggggatcgtgtgttttcgggaggcgacagcggtccacatgccatgccttgtcgttgtgatttctgtttgatgcttagtgatatttccatctgagcgggacggaattttctaccatcgtgcccgacactgcgcttagaggctagtacaaagtttgcatcctttgtgaagaggtcaacatattggtcgtgggcgccaggcgtgtcagaggtcttgtaaaagtcctcgaaaaactggacaatctcaggatctgtagtcagatctgaagggtaatcagacttgtatgtgtgtggcattttgttaatgatatcaagattgagctattaggtggtagatagagtagagagacgaatggtagtcaatgggatcgagttccaaaccatggaaaacctccaattaaatcccgccttgctaatggtacagtatccgcacagttcaaaaacagtatttctgcgtttgccgccgcctgaacgcacgtctccacataagccaatcgcactgtgagaggggcaagtcaatatttgtggcgcctgtttgaactttcaacagattgtggctcgtgcggcgcagatataggatatgattttctcctttgagttaatctgtgccaagcaagtaactaactatgcgcacgccgcgtcccgagaatccttccgcgcttgcaacggacttctgagtggtgtgagcgtcagcacaagcttttctgccccgcaagaaggtcaagcttcgtaattcgagactgatcatgaaacattagttgtattaggtacctatttgccgtcgcctactgcagtattatcgcgattgcgagtcaagtccttcatgggaatattcccggggctttggtagtaggagggatggtacgtttcctccccagtctgcaacagagaatcagggctaggccagcgctgacctgaatgcctcgaattctcggcccttcttctcttctgtttgttcaaactcatgatgatagaaatgagatatgccacaaagcatgtgctcgcgatgaccgagtagctgacgacccatgcgccgccagcctggccagcgagctgcaggcccaatccaccattgaccactccaagaaccatgagcgcccggccgtaccagatgtggatgtggcctaccaagccgatggattgatgcttggaaaaatatcggtggtgcaagtagccgaggacgggttggaaactaagaaggatgacgactatcagacccagtcgcgtatgggtttgcttgccgaactagatgtgccatcctggttagctggtctgaattggatataaaggccatctcgatatcgcgaggagcaaaaaactggactcacgagcgaagtttgcctggagtatgtgactcccaaggcgacaccaacccacatgaggatatacgcgaccagctgtgacgccgaatggaggaaccatttgttgaatactggcatgagaagagcacccaagggataaatgccgacgaataccgtggtcataatgatgccgtgcgcaaggcgtatagggctgaattcatccgtgtccacgatcccatagtctgagtcggacgcaagattcgcctggtcagcctcagaaaacgagtcggcgtcggagccgatgctcgctttgctcaagtccacggtgaagatcctcttatcgtcgtgatgctttatcatcgctcccgtgcttttgtcattcaccgcatccccggccgaccaagctgccacccagctattctgtcctgtcaggtcgagatcttgacagtccccgcaccgcaccttggccaccatcctcccatcagccgctctcgacccagatatcagctcgaccttcggtcggtcgacgtatgtcggcataatatggttctgcccctgtctcgtgctgagtgttacattgccctcgccgtcctggtacacgaggaagatcttggcagtcatcatgttctcgccgatgccaagggcgacccacgagtaggtatcgggcgcgtcgagttggagatagacatttccggatccagacgtggctgcctcttcgggaacaccccagttgaatcgaatatcacggctttgaccggctctgaacgatgcctgcgcagaggctgctatctgtcagctcaagtgtcgggtgggaggacggcagaacaagcccacgaaccgaggtcaattgcgaggccgacaacgctggccaggatgtgcagcgcccgcatcgtctctgcccagtcgccccctggagactcgtagggctactcgtagggctggctgtaagtggcccgggaagtaagaaatccacctgcggaaggcgattgtcggaggctggatcaatgcatcactctcgggagggaaaaagccttctgcgaatgacgacaagattgaaagtcgtacaaaaggacgaggagatgtaacactagaggatcaaataatctcacccatcccatcctaataggagggctccatgctaattcatgcagtcagcatccagccctgcccagagacacaaccaagcgctcgacccctgtctggcagtccacgtaccgcgtcagcccaccggaattgtgcaggctctgggcttgattggatccaatggcactgggcatcattaataaaacgcactaccacgtcggcacatctgctacccacagcgcgagcgcgagtaccacctgcgagatgatccttctcctgaacaggatagcagccacctcaaggatcgaccaagtgtgcttggttcccaaatccattccccgcattcaaccgcacctgattggctcggtgcttcggaccacgtcatgaggtctgagaggcaactcaacccttgcccttgtgtgatgtatcaccgccagcaaatgaagcttgctgtgactaaagcaagccactcacagccgcacaagaagtccgaaacccctgacacgaacaaaaaaaagtcaaaaaaatcattcgtcttatttatgtcttccgttttggcttttctttttgacaagtgttagcttgacctgttcttgagcttcaaagaggcggtgtcagcacatgtaagacacgtgaggcaacaacatgccagtacttctcttttcccaccattcacaacttctgtcacctctcagataagtatttttgcgataggcttgataagacactattgaaaattatgtatcaaaatatgatgattcacttgggatatcaatagctggctccggccgagtggtgttaagaccttattatcaaagcgccatattaacatcagctcagccttgaggagaagagactgagctatccctgtcaacggtgggcttctacccatgagattgggctccaaggaaaccacagcccgaattcatttctagtttatcctgccttggccatatccgtgatacttgggtcagagctcctttgagtagaacaaactgtacaccgtatgtagtcgtaaaattcgggcaagacaaaccccattaaagtggatcaagggctgacagaagcgttatgattttgtgaatccctcttcgcccagacttctgaacagtgctcgctttgtgccaggttcataatagtgtccaggccaccaaagcttgccttgcctgccggagcagccaccagtagtgctaatttgcccggctgtatcccccgaacgatggatccatggacaccttaccttcacccattttcacgaaagacctacaacaagcatctaccagtatttttccataatgatgtcaacgtacagtctacacagaaacacacgtacaacaggaatcaatcccgagaggactgtaatgcttttcgttcactcatcctatctaggctaggtttgagctggcatctacttacctagactaaaacgcagtattgatagacaaccaatttattcaggctcatcaattgcactcactggcagtatgcttagtgatcgaattaaaatgattataatgaattctcctttcaaaagttaagaatcgagaaaatgttaaacaaatcacgcgccctcagtatcatagagcccaacttttaggcttagagatttagaaatgaggaatgtgtacttcataagggatgatgggacgtggaaagaaattagatgtgaaatctaccactcactcactttgtgcgttggttactataggtcctatgtttggtggtatttgaagggtgtgaagcaataacaaccgtggacttgccaagtctgagggaactagttcaacaagatggcgagggacgatgctgccgcacgcttcgtagcatctacgagtgtcttgcaatcgttcgtcaaaggtgaggcgccgttgcgcagtagaagctcaaccagtctgtcatccggagtctcttcgttgacagaaacttgatcgtgagaagcaagggtatcaatttctcggttaaggcttcaaatataatttggcatgtatagttagtcacctctgagaatagtcaatgtcgctaatgcattttcattcactagctaggaattatctactacaggctgttgaacacatgctcaattttatacttggaaagaaacggcgttgaagttaacgtttccagtcgaagggcaggcgtccgtgatggatgggccagtggctgaaaggccgttgaacgagactgtgacatctccggtacggccattgagaggaaccttgtagtgataagccttgccaatttggttgatggcagaagcggtggttgtaacaccgccaacagtgatgtcaacagtcccggcatcgttgcgcaaggcgataacagacacaacatcttcggtgcccagagttgcggactgagagccgccttgaccccatacggtacctaatttggtttcaacattagccagtgttctttaactgtacccagcgtaatgtgggtggataagagaagattgtaataacttaccgccatcaccgcagacactcttgggggttgtacggtaccaaacaaccgcgccctcggaatcaatgctgataccatcagtagttccagccttgtaagagttgataaagtagggcagaacaaagcggagagcggtatggtcgtgcccgttgacgtatgcctcggcgccagagacaatttggtgggcgacaggggccttgaggtaactcgattcactgtagtcgttccaggtgatgatctggattagacttggcataacctcttgggtcatcttgaggcggtcgaaccagagagagtcgctagatgaataccagtttttaccccagttaggcaggtctatgaaagttcagtcagaaatggttctttgacaaatgtctcgctgatataaaggatatcaagtagatgtgtgtacttaccaacgtagaagtaggggctgacacccatcatgtacgccttgtcgcccaagacttgttggtaatcccggtcttcactggggaacatgatctgtccattggcctgtggccacgcattccagctaactgaataagggaaacagaattagcctcaaaatttctattaaccccacctcccgttccgggagtcaacgtgataaacgagagaaggcaagattaggggaggatgggaagctagaattaacgatgagacacttacaagctccatcaatcttgtccagctggttggcaacaccggctgggcctatggaagcccattccgggacaaggaagataccaccagtaccagagcgaactgcagcccagttgtcggcccagccagggcctccaaaggtagacacaaacggaagcccatcgacattgaagtaacttgagcgtcccttccaggagttaatccaactagtcacctgatcaaccgaccagttgtattgatcacccatatcgaaagagatgaagagtttaaaaccggcagcgtcggcagcgttgaaggcattagccagctgatcagcattccaagcatcgtccgggccggcgttcaaggcgaaaccgtcgattccagatcccttggcgtcgttgatctcggtttgccattcttcatagctctggccgctggtgaggccaagcatgtagtgggcgaaaaccgaacgagggacgttagcccgagtctggagggttgaggcaggttgaacggtgacatctgtaggcatggcagatgccaggcctgtaaacgccgcgaaagcgaccgcaacagatttgaggagcatggtggccaatatgcggtgtacgtaaatggagtgatccagatctcttgtggaggaccggctgcgggaagagagcagctgtttatatacgagcattgagggtcctaataccttataaggcggcataaggccgcagggtatcagccaggatgccagtccgcccacgttcctttcacgacacttgccatggcccacgtgaactaccgcaagctagcatgcaggaaccgatctacttttaactatcttgggatgcattgcatggtttcaggtgtcgacgacggtgagatacccagtaattgtggccccgtcagcgaattgccaagcgaggaacagggctattaataataaaattaatgtctccaaaacttgtacaaaatgcgctgaatgcatcctttctcggaattaagccaatgggaccccagcaacgcccagccgaataccctgctgattgcctgactcgtacacatgcgatgccagggtacggctcgagagagtcgcttgcaatcgatgggcagtgtctgtcaatatcgaagtcaagtctcgaggccacccatttccattaagtcaagggcgaaatacaatcctcagcggtaaataccacctttgacagccgaattattggggtgcatagacgcggtgatagtggccaacgttttctcgtgggattcgtatacacaaatggtgggtacagatagtaccagggtgtttgaggagtgattttactatgccctcgcggtctggttcggatggagggattgctctcgaccaacaggcatcatatcttttctatcctcccagcattcgattttcgcttgagatagttaatgatccgataagcaacttcatttcgaatgccgcttacatcatgcccgcatccagagatattgcttcttggttattgcggtagtatttgtcagatagcagatacgaataagtgctcgcttaagaatctcatcatgggctggatatattgccgtcagcaaacataagacaatttcaagtcagcgagaagcttctcgccaagagaacgcgcctgggacagggttatgaaaaatacatgacttacaaattgatcagttgtagataatcacttggttacttcattgatacccatcgggaacagatatacgtgcaggataatgcgaatcttatgatactccctaagtaatatgtaaacttcattggacggaagaacgaagctcatctatgaatatcgaggttctcggcaagaacaagcgttgttgctctctaagtgcaatcaattagagccaagttcaattatttcaagaaaagtacaatactcttcgttctaataaccccttatatagtttatgttgagtctcttagagacaatgccctactgctctgctttatagcgcgacctaacgggtatccaaagagttcgttgcaatatacttgcagagtcattgccttataaaaccaccatcgtcgctaagtatgctcaatgcagctagtgacctcctctgaggcctgtctactcggttctgtgaccttgtacaccaatgatcagtataatgatagaacaatcgacaatttcccaactcgccattagccaagtttcggcagatggttatcgcgaagaaatgtataaggtcacctgtaaaatctttcgttaaagcgactaatgaataggatgatgaaaattagcgacaataaggatgctgctaatggtgatttgttttggagtttcggactggaggctgaatatgtacattaagactagttggtgggggtgctggagatgagagtaagcacacctgaaatcagcttacagaacagggacaaaccgggtattgatccgaatacgacctcacttttattggctttttgcaatatctcggcacttggacaaatttgccagtgcgctggagcatattgctccgccgttcacatccacccctgctcacacccgattgcaggtatcagagcatttttgaacacaaaacaaatggcaaaactttaggcggtcttcgaagaaatgtaaaccaaagggaggtataaacaagaaatcaataaatcagtcccacgccaccagacctgtgtcccgaatttcagcaccacacacatatcgggagagagggtcctagagatactgtcctattgagtatctctaggaaaatgtcattaatataagctgcgaataagcgctcacgattattcctcttaatcatagatttgcgacccagagcaatcgccccgggcgaagcaaaacatttgctcgtatgagctcattatccaagtctcaaaccctcgataggcctcctccgtatactcctcctttcgttcttcatccctttgctctgtatctgaatagccgccatccaatggggatggttccggcctttccactttgtcgaggctgccagataaatcttccaggatagattccagctcgctctccgtcgttcgaataccggaaaatagaaatcttgtctttaatttcatctcttcgcacgctagcgaagcctccgaaggactggatccttcagaactgattgatggagaagtctggaaatcttcctggctgagaaggtgtagatggctccagttcacctcagaccgtctttttctgttggcattgtggattgatgtatgaagaacacaagatccgctgagggcagattctccagctctgcaatctgcacaccgctttctccggctgttccgcctcttaacgcttggtccgggggctgtcatgaggccgtccatattccagacatgtgtatggacaacagcgatgctcttctgctgcggaagcgacattttggggtgtgtgaaggaaggatagcgtgcggtctatctcaagagatgtagcaattagagcccctgaatctggaccaatctgatttggagagtgggatgtgatttgaaagaaagtgggattggggagaatgtggattttccccgcacaaccacaagatttcctggagttacggaggtagatttgtgtggctcagccggaatacgacgtcattaactgcccctgactcgcgttagctccgttggtcggctgtaagcaaaatgggatagccgattcgggtgaaaatgaaaacgccgaggcttgtgccgggagtgacatttcgggaaagggataacctatacacggagtacgtatattaaacgcgcttcacatcaattgttttcaggtcattgaaggaagtatatctaataaacagtctatcaagagttgcgctgggtatattttggcctccctttttatgcaaccgttgcattcaacaattggaagcaaaaatggtgtttcatcctccctcatgggttcctccccttccaggtaagtcttcatccatgcaggcaataaatatacgtttatctcattgattatggcttgcgcagagatcccggactcaatcacggttgcagaatttatcagcagcgacaaatatggcagacacccaaccaaggcatctcggcggccctttacctgtggtatgactggtcggtcgtatacaatagaggaggtgaatgagagagttaattctcttgcaaaatctttgcatgcaatactcaaatttgatattgaaggtggaacggagtgggatcgcgttgtggcaatatactctcttaatacagtaaggcacccgttggtaatgattatatcagaactttaactagactctagattgactacatcccagcaacacatgcagtccaccgtctctctggaatagtcactcctgcaagcctgacgcactcggccaaagagttggaacaccagcttcgatcatcaggtgccaaagcgctattcacttgcgtcccgttcttgcagaatgcaatcaaggcatgcgaggccgttggcatctcccaagaacacatctttattctgccaataccaggtgtagttgaacgagttccctttagatccatagaggatttaatcttagaggggcgaaaccttccaccaccactgctccctgcgtggattgagggacaaggcgcgagacaagtagcctatctctgctactcgagcggtacttcggggcatccggtgagtaggctataccaaattattcgaaaccttttgtgcttacgagatctagaaagcggtgatggtatcccatcgcaacatcattgcgaatacaatgcagactacacttttcgattcctccgggcgtcaacagagcggagtgcgcacacaagtctcggtaggagtgttgccattcagtcatatttacggcttgactgtcatttgccatgttgcaatgtaccgtggagacgaaatcatcgtccttcccaagtacgagttccagtcatttctgaactcagtccagaaattcaagatcgaacaactgcatatagtgccacccattttgatttcgatgatcagcaatccagacaagtgtaagaagtatgatctcagcagcgtgcgcctcgtgttcagcggcgcagcccccttgggcagtgagacaatggcaaaggtatcacagttatatccaagttggaaattaggccaaggttacggtaagtgcggaaatgcgaatgaaaatacccacaaatccatctaacttattttgtctctttcattctagggttaactgaagcatcgccgagtattacatcaacaagtgagcatgacatcttcccaggctcggccggatcgatcattccaggcaccaaggtcaagattctcgatgccgagggcaatgaggtgacccagcacgagatgcgtggagaacttctggttcaatctgactctgtgactctcggctatctgaataatgaacaagagaatgcccaaacgtatgtttggcaccatgatggacgatggctgagaactggcgacgaagtccttgtacgcaattcaccacaaggccacgagcatgtcttcattgtcgacagaatcaaggaattaataaaagtcaaggtaggcaccctcacgaagtaccgtatgttacaaggattcacttactgactagatcatagggccatcaggtggcaccggccgagctcgaagcccatttattagaccatcatttggtatcagattgtgccgtgattggcatagaggatgaaagagcagggcagcttccgaaagcctacgttgtgaaatctgccgaggcgagaaagcaatccttagctgatgaaaatgtaatcaaggcaattaactcgcatatggagggccacaaagctcgccacaaatggctcaaagggggtattcaatttattgacagcataccgaagagtccaagtggaaagatcttgaggagacttctaaaggagcaggataaaaaagcgcatatttctgccaagatttgagcaacactctacggcccatgaaatttgtctacaaaaggcacatatgtcacgtcatattgctcatcttgtctagttggttgaaaatgaacaagggagaaaccgcctacttcgaatccgataggtgatagttaatgatcaattaaacttactatatccatcatgatacacaatagaaagtcgctgcgctctgtatagttgctaaactggtctctatcgtcgttttattaatgcttgttcgcgttgcctacacaaccttaattattagaagcatcaattatcctagttacccataattatcgaaatcggaataacatgcatcattatcctcttctccaacctcctcatcctctcctagatcctcctccatttcctcttcctcctcctccatttcctcctcctcctcctcctcttcaacttcctcctccatttcctcttcctcctcctcctcttcaacttcctcctccatttcctcttcctcctcctcatcttcaacttcctcctcctcttcaacttcctcctcctcctcttcaacttcctcctcctcttcaacttcctcctcctcttcttcctcatatttatcatatacttcaacctctccatcctcctcctcctcatcatgttcctcctcttcctcctcctcgtattcttcaacttcttcttcctcattcattttctcttcctctatttcctcttccaccgcatttagactaagtccctcctcagattcaggctcctcgtaagtctcagagccatcattttctagatattcatcgctggtaggcccggagtcatcgtttgcttcaaaataattgtgttgctcgagatacccgagatcagaaatgttatcttgaccatcgtcttgataatcttgctgctcaaagtggtcttgctcctgcccatcgctctgccagccatcgctgggattattgttccaggtgccaaactcgtcgccaatgtcatcgcccacatcctcattgtcactactacagtcagaatttccattttcattgtcatcggcatgccaagcattagtggaaatgtcgttgtagtcgggttgctcatcataagtctcctcgtcaatgttgtcgggattcccatcaccgttttccgttccggctgtagtatgattcccatccctaccattctcactcccactctcctgattgccatatgtatcgtccagtctctgaccatcttcgttgtcttcgttgtctctagtcacttcactgtatctatcaaaatgaggatttgcctcatcatcaagccacgtctcctcgccatgagctttattttcgtggatgtactgattgccatccaaagcaccttgaacagatcctgatgcgtcgatagagatgttatagttgtctgaatattgattgtaggcgtagaagtttcctgtttcaacgcctaaagacccaggaggatactcgtcttcagagtgcggagccagctcattgtccgcaccgttggatgatagatcgccccagccttgcccgttgtacagattctcaacgtcagcttcctccatcgcatgagaggggccgtaagcggagccattgtctgtcgtgtccccatgatagtcgcctgactgattaaattgctcagcagtcgtcgcctgaacaccgtgttcttgttcccgaggcaaataatcgccgtcaatggctgctgctagcccgagactcgctaagccaacaccactaacagcgccaagcgcaagagcagcattggacgagtgcccccttttcttggaattcgagtcgccttttttctgtttctgttccgggtcggcgtgttggggatctgtaccgttgcccgagttaacagggactaacgatggatcatataccatggtagggttacttggatgtgaagctgggtgagtgtcgggccagtttttagactctggatatgtttgatctatgtttggctctgaattggacgtgaggccaccgtattgtgattgagatccaagtaggtcggatacttggttgggaccttgctgattgtctctatatctcgttccaaagctcccttgtgcttcagcagcaggtgatgatcgctggagcgcgtcggtggccgaacttgtaacgccggcatatgagtgttcaggagaagtaggccaggggccagcctcggtatgggaatagggggcttggaaagaatcagaccccgagacttgaccacccgggttagattctcgagaccagcccttgtgagacatatgcaaaccgaaatcaacctcgtctggtttagtttcttcattgaaagcgccttgaggctggaccgaggaagattgagagggtttagactcgccatagtcgaatgttggttcctctggagataacaacccatagcgtgatcctgggaggtctatggcgccggaacctaaaagctctgactctgcagtgatgggttgttcagccacaggagaagagtgtccacccatgtcatgaggactttgctggctcgaatcaagacctggacgttcttccagccagacgtcgttggtgttattgatattattaatattgttgatgttgttaatgacgttgtttttgttgttgttcatcgtgacgttgcttggggaggaactgcgtgtagatgaaaagttggcttcttcgtcctctctctcgggaggctcattttccggtgtgttcatttcctcatccccgaaaccttcgaagcttctcgcttcggcatacaatggtgatcttgattcagaatatgcatccgcgtcttcgtcgatgttatcatcgctgtcaggtgcatccccattgccctcatccgaagatgtatcatgatagtcgtcgtcagagacccagtcagaagaactagaatccgcatcagtagttttaggggacaagttggcatctgattcgtgcgcatgatctccctcgtacatgacgttttgttgtgtcaaatggttgttagcggtgctggtttgttgtgccgaatggttgttattgataacatatgtcatgaaaccagctcccacggttcccgccgccgctcctgcgattaatttcccaccgggattcgaatggttgccatgtgacttcttggatggcttatttcctttgtcatgattcttgtcatcacgtgccccattggatagtgacttgtctcccttcccgtgctttgttttcgacttgacgcggtcatgggatgtcgcgtctagcttcttagtcaacttgcggtctgtccctagagctctagccgaatcatctagtttcttcttttcttttttgtcggataatttgtcctttggctgactgcgaatcatagcgcccttcatgtccaacgtattcttgccaacccccttcgtcttctcagcgggtgatcttacttgctggccaactttgtgtctcggagcttgaccttttgcaacctctctccccgtttgctttattccacaggaaatctgcctggcattctgggacgggtcttggtgggaaggttgtggaggcggctgtttggaaagtgggctaagacttcgttgagaattcttctgagaagggtgcaaaataggcttctgggaagtctgcttgacgttcggtccaatgctctgtgggccagactgctgtatattccatcggctaaactgttggggagtcccttgagagtttcgttctccggttgctttcggaccagaagatctaggcgttatcgggcgtgtgccttcggggctcgcgactccccttgaagcctgcttagaaggctgtgggagatcctgttggagagctcgtgtggagggttgatggaagttctgttgagcattgtttcttatttgctgttggaagttttgctcctgaatgttctgctgatggaggctttgttgaacattgtgccggataatttgtggttgcatattttgtggttggatgttctgcggctggatggtttgtttttggaagccctgttgaacgttgttctggatgttctgctgctgggtatcttggtggatattctgatggacgttctggtggatattttggttgaaagtttgctgggtaatggcttatattgtgtgctggacagattgtttgctctttgctcctggatccgacgagctagtgttcacttgacgttgaagaccagcattcaaaaccttttggtcaccgcttgggatctgttgaagaccaggttgagaagtcttttgaacaactttttggttttttggccttaagcttgaggaaccggcagctttctcccgttggcttccggtcatcctggaagtctgttgctgttggacaatcggctgtttctttgccattggggctgccgaacttgatgttgtctggattcgacttctagcttctatcgtcccgtggaacgtttgctgggaactctgttgaacagtctgattgaccgtctgattgaaattctgttgagaagcttgttgcgttgtagcctttaaaggtgaggaaacagccttgagttggtgcttcttgcccgcttccaaggcccctttgacaaggattcgttcaacgtcccccggtgctgtctccgacacgaaacgcggttgccttactggggcggtgccaggggcactgactgtgtgcgactcaaaactacgatcgacagacacttgtctcaccgcatgagagtcttggccgcggcttacctttaattctagacgtctagactcgttctctgatggatttggggctctctgcgtatggggagcgtagtttggagcgggcacgggctcgttaaggatgagagggtcatgggaggaccaactactcgtaatcggtcttactatgggcagctttttcttaggcacttggggatcagttgctctattgagggagactggattgtggccagactgattggtagtgatttgcctgggtgatttggctttcgccgcagcagacctgtgactctcgagtgtagacagaggggtgcttgatccgacggcggatgacctgacatgaccaggcttggtagacggcacaccatgatctgtgttgacatcagatgtgtacggcttggtgatagaagtgctgcgtgttgacgctagcgttgtagaggctgaggtagcagatgccgtgtccctggaggcaaatcctgttggagacaatgattcatgagcatgggaagttgatgacggagtattgcttcggtcttgggctgggacgttcttagggctcctcgctggcgcggtcgccttctcgatcgtcgttgtggattgagctgtggtcggtgtgctcttctgcggcttcaaagggccgggcgccatggacgtagcggaggttttgtcactgctgagtataaatgttagtggacagtgtaccattgatgctcctcttgttcctcgttcaatcataccttgcttctggcaatgtcttggagctagatggatcaacataagctttgacgggcttacgtttgacctctttcgtttttggaggaccaggaacaagagagccaggatattctgaactaaagagtggtcctggcggcgaggccgtcgagttggtagactgagattgcgagggaaacgaagagcctgattggggtggcgaaggggaaaacgaaaatgaagcatgcgagttttgagaaataaacagttcatcgacaaaaacactcgaagagactgatcgcgtagtgggagagcgaacagtgggatctgtggggagtttgccattgcgagaggacttcacctcgggctgaaggtgacctggggtgctagcactgcgcccatgaggcagtcccgctggacccggaggccgtgcaagcggatgagaaggtccctggggcgatgggatagtgggatatggaccatgggaaggcttcggtttgggcactttcgacttccctgcacccgtaaacaagactccgaacttctagacgatggttacgtccagctcagcagccttctccatatggtgtgaccatggcctcttggccagatggagctggtcaatgtagaacggccttcgctgcctatcaatccattcccaagcctgctcggctccagggagcttcggaatagcaacagttgaaggctgagcttccggagtagaagagattgctgcgggagacagaccggagaatctctccgcgccagcccggaaaaatggagggaatttggctgaagaagcagggccagcgagccaattctccttcttgcgtgtcgaggcatccggtgagcaggcctcggcaatgatggaccaaaaaacatagccgtcaggtgtggcttgggacaagcagttcacgcaaaacctgcatgtctccagaatgctgacacatgcctgcgaatgactggtttgagattgatggaagaatccaaggatggctggatacttctggccgctgccttcaagggacggccgatatttcggaaagtgattgcaaccgagggcacgaggaccaagtttaagggcaacaaactcagcagatccaggagctgcaccacccgccagcggtggactatttgctgagttagagaagctacgcatagtttcccgtacactaggtaaggctttgtagacagaggcaaagaaatgaaggacgggctgtaagttggcaagtgctgtaagaaagatggccaaaaggattactgaagcataaccactctctctgggaatttctacttgggatagatagccagatattactctgcgtagagatgatggtcagcaggtcaaaagaaaagggccagacacgccctccggcctcttatctcggctctacctcaccttgccgtagccttacacatgtcggctgcacaccagaatcaccctccaccacttcacgaaagttaattttagcttccttgccacgtatggcagggggtgtgtgtttacagccctcatggatcacgaatgctaaatcagtaccgtaccgcgagaggaggagcggaggatatgataaaatgaaagtattggttgagctattgcttgaaacctgagacctgcgggctcgctatttacctgctggcctataaaatcacggctaatgcaaccattacatgtggcgtctgcaagaccgagggatataactcacgggatgcaactacgtggtaaggatgcctagtgctgacaaggcaactcacatagaaacaaggcttgacccctcgtcatggtggcattgtctcacctggtagccgcccagaacaagaccgatcatcaaacgactggacgcctcacgagtaggatgctggttttctccgacattgttgtccatgtatgagtcagatgttttttcctggtcatggccgaacaaggcaggatgataggagggtaaagatgcactaccggcggtaacagagctgaaatagaattttccaatgtgcaacaatccccctgaacattgcatgagtccagccttgttcacttgggccgggccagacagcttgtgggagtgtttttccagccgttcgcttggtcgaaaagatggtaacctagctcccccccacactcgttgctcatattccgttgatactacagctttgtcagttaagacagatgtcgtccttgcccgagatggctccatccagcagagcctcgtctaccagatccgcgacattccccctcaacccagcagattccaaccttgcccaacgcctttctttcctacagtttgatagcaaagccgccgagcccactgccaatgacttccaacgggtgcaggagcttatgctccaaaaccgcccttccgcaaaacgatcctcgacgttggactacaaggatgccaaccaagctctttctatagtcgctcaaggccgcgtgcccaatgccaccccggggatgatcaacgccctcgtcaagagcggtgccgacgtcagcgttgctcgacgcaagagcgacaacatcctcaagatgttcaagggcgaaaatcaagaggaagttcgcagtgacgtcctgccggtcgcgacgcggaactgcttagacgatgtcgtgttcgctctggccctccacgccgataaaatatccctcaaccaggcgcttcctgtggccatcactaccaacagccatgtcaaggcgtctatccttcttgctcggggcgctgacgcttcaccactgtgcactgccttcctcgatgtcgtggccagagataaccacgagatggcagagattctcctcaaggaggtcaacggtgcttgccagagctgccgcaacaaggcactggtgcacactgcgaagatgcgcttccccgttactgcgcagaagttattgtctcgtggggcagatgtcaaattcgacaacggcgcggcccttcgagcagcaatacactccggtgccgacgatatcgcctttcagattgcctctcatccatccatcatgggccaggctgtccttctcgacgccgtcgtcagcgatgcgtacaattacaagaagtattcactacttccagtgttgtttcaagctggagctaagggcaacaccacagtcgagatggtcatcaatgctgtcaactcacagcagctagatctgatcaaagacctggttcagcaaggggtactatcggcgctatccagcatggcagttggaacctgcttgcggtcatccatcaacgtctcgaggctcgacatcctccaggcgctccttgccggaaaaccgtcaccggagatcatggccgaagcattaaaacagacacattccatctccaaattggattatgtgcaccaggtggttgaccttctgcttcgctccggcctggcagggcatgaatccgtcagtgatgcacttctgtacactgtcaacagaaccgtctcggcttccgatgagcgagttcatctgaatctcttccaattgcttctcgccagcggtgctgcagatgtcaatttccatggaggcaaagccatcgtagacaccgtctcccgagcacatgtcaacatcctctcccttctcctacaggccaaatatcgtgtgtcgacagattctcttgctgcagcgttgacccccgcgatcggtgtgaagccagatgatgtcaagattcgcgtcatcgagatgcttcttgggaaaacaagtaccgctggtccgatgggagcgactgtcactccccaggataggcagcgtcttatcagcgtcgctatgtctgcagctacgcagtacctcgacatgaaagttctctagctccttgctagcctgaccacatccgtcgatcccttcagcactgccgtcaccactttggttcacaggacaaacggctggtcttccatccagggccttgttgtcatgcacttcctgttagagcacggggcatcaggccaaggtgttgaggatgcctacctcaaggctgctcaagcccacacatatgaggccgtcaatttattagagccagtggttgatcctaagatacggctgaaggccctcggtcgtctaacgagctcctccccaaagtggattgagcacaagaatctgtggcttctgaaactcctttgcgatgggggatgccaaggcgactcaatcaacgccgcgttgctccaggcggttgccattgtgtctaagggagacgggtccattgcggccttgcacgttctccttgattcgtctgcaaatgtcaactaccagaatggcgatgctctccgtgtcgctgccacaagtggagctgtcgaggcccttgagatcatgatgcgatatggtgcgagcagtaactcgatcgcaaatgccatccacaatgccatttcggcactgctcacagagaagagggccctgaaggtgattgacactcttgtccacgagatggaggccaacaagcccggcgtcaagctcgacttgaggagcaccaaacagggccaggctccaatactcgtgacttgcctgtctgtccaccgcaaatctgcactgctggtcaagagactaggagagctcgggtgcgatgccgatgagcaattcacagcgaccatccacgagtaccagaacgtgggacaggaagtgacgactgtcctgatttgggctctcagcccggtgtcggcaagacagatatcttccgaggttatcgctgccctcattgaatcaaagggtatgaatccaaatgccactttcctttgcccagtcatgctaatggggaccaacagcaaatgtcaactatgccacttctaattccaagaccacgcccctcattctggctgcaaggtacggccgccatgatatcgtgaagaaactcctcatcgccaaggctcgtcccactactcgtgactccttcaactgcaccgccctctactacgcggcgcaactcggtcatttcgaggtcgtgaagctattggtcaaggccaagtcccgggtaaatgacggtagccttcacgaggccgccaggaacctccatagcgacgtagtggccgccttgatatccggaggccacgaccccaacttccgcagcagcaggcctgagcataagggacgcaacgcgctggaggaagtttgcctcttggccgatgggtcgaggaatcaaacccgtctggaggaaacattgatgggaattgcagacggtaaggcaaaggtccttacaccaaacggcgacaggaactgtcttttccttgcctttgacaatccccgtcccatcccagtgaccagcatcgtcctggacagaatcatgtggcgtgatctcaacgacgagaagaacgttttcatccgagaagtccgtaagacaggtaccaagatcttttactcgccgtccatgttcctccgcaagggcctcgcaggctgcgatcccagccacatcaaccatctgttgaagctcctccacgagaaacagtgcgtcgacaggtactacgcagaattcggccccggggacgacggcatgttccaaccggaggatgcagtgggcgttcctgtggcgattgccagggaagaaaagaagcgccgggcagatgctgagaagcgccgggcagaggcggaggagcatcagcgtaagctgcaacgacagcagcaggaggcggaacacaaggtccaggtggatggatgggtgcaacaccaaaagaggacacaggcaagcctcgcccatcaaagtaagatgcaacaacaggaacaaattaaaaaccagcagcttcgagcaatgcagcaaaaacaggccatgaagaagaccaagtagtgttgagcagaacgagttgatcacaacatcaagtttgaagttctttttatatcttatcctcttagttaactcaaccgatttattcaatacaaaggattcaaaagcctatggatatactaatcatgagatcttaacctactcatagacacggtagttgtaggtttcatcatagatttcaagggggaaaagattccactctgctagtttctaacaccccctctcccacgatcttctttatcacacactaaggaagtcaacatctgaagaatattagtcaagcctgcgagagattgagaaggattttcttacttatccaaattagacaccgcaacaacctttccaacgtctccctggtcagtaaaccctctaccacgagcgacatacaacacattcttgtcgttctgggatcggccaaaagcaagtgaagcgcaatcagccaagatggtttcgttggcaccccctgaaacgatcttattttctccggtcctggtgtttatgtagccaagggcattcgtaggagcgttggacgcaaagtagatgtttccagctcgatcaaaaatgaaatcgtcgattccggagaaattttcagaaacgtccacaacaagctctgccttggcgcctggtatcttggagcctttccagtcaacacgtaggcgataaatgtaagtgggcgcagaagcaaaatagagatagccatcgcgaaatttggcagcaaccacacccattccaagcggagaattggggagcacagccatctcgggctccgcgaaggcatccatctcccatttcttctcaacaatattcagacgacccatggttcctctcccagaatctgcgattaggacagatccggggcttccaggaattggggtgaggccattcaacaggaccgtttctcgtcccagatccccgatttgctcaactttcgctactccatgctttgaaatggagagtcggaaagcctgccatgaaccaacagccggcgttaagggtgtaagagacgtaacgttgccgccgacaaaaacataagtctctactccgttaatttgagggatttcagttattccccagagggattggaccccataaacgcttgctacctcctcaacagatgggttgcgagaagaggggcccttcacggtgtagaccttggggccacccatggcagaagttgcgagaatgtcaccgtttgggcgaatgatggtactttccaaataggatcctatcggcgtctctgcaatgaccttggtggaaaccaaacgacgtccgctctcaagaacgggacttcctgaaataggagcagctagggtagcatagtgcaatatagatcgtaaagagaccattttgattttttttttgtctcaaaaagctgcttgctcttcaatatatgacataaattaaatgtttgatgaggttttgggatctttaagcttgacaaaatcgacctacgatcaccaggaagtcaaggtgttttaaatatcgactctgaaaggcatcttcaagtgtccagaaccgtcccacatggcattatgaaatcatgaccaagctcggacaagaatgaagtatattgagtgtacaaagggcttacaaacattgccaatgggacaacccagtccaacctctattctcgggacaacaggtgtaccgaatgggtgttttctgagctcgggatcttggtagaaaccgatctctccaagctttacggagataatagtattagccccgtggaaattattcagttcaacggagattttcaatcaaatcaatcattccaacttacaaatcgggtcaataagctcggcaaaagttgccaggagagggggggaagctagggccatttgttatcctggatttctatttcgagatctcacagctctgagatttgtatgagattaccaacaagccaagcaaactaacctctctcactttgttaatgcgaaactttcatagttttgagggtggtgtcattaaacgtaagtatcctaacacaaattgaatgctacattactgtgtgtgccttgctaaattattgtcaagcagagcgaaagtaaatcagtaaccaacaatcaataattgtttcatttgaaatgaatatacttgagtttgatttccacctgcaaaactgtacttgccaagcattgatacggttatggttggtgtgtctagggtgggaagctggagtgtggcaaactgctatagtccaaatattgtctcgagagcagccaacaacaagcttccatggctgagttggttacagcgtcggtctcatacagttgtctgtgtgatcctctccaaagagtgggttatccgaaggtcgtgagttcgagcctcactgggagcattcaatgttatctttttgatttttctagttgtgtccttctactccccacttttcattaaacattttttgctggtggagactctgctcggtaatatccttaccagtcattccctcggaccaaaagacctcttcaaagcgcatcttacaaaggcatttccccccctttgggtggcatgattgctcgactgaccgcgactgattcgtagacccctataatgcgcgagattataaatgataagcccgcgccgtatgtgtggaacttgcaaggtgagagagattctcatgcgttggtcgtctttcctctctctcgcatctctggagagcacccagaccagctgctgaggaacacatgcatccatcccattggtctcacgattgagactgcctcactggcgcaagtcacaccccacccgaggagccgtagtggtagattttctattgctttggaacctaccaaccaatgacagtcggtggactgaaagctaattcgcgaaaagtaatttaatgtccatgtctaatacccgttgcttcagaggcaaaaggttgaaccatctctctcatctatggagagttattataagcgattaatgaaggattcagtcggctgttggcttcccgctgatgctttgacactcaagagcgaaaacgaacttgtgaaacgaagaaaaactcgtgtaaaagccatcgcatattaaccatacaataagcataaatgtttttgaaatgcggtacgtcgacaccaaatggcggtgccttgatgcctcacttcgtgtttgccttgctacatgcactttgcagtggagactccagttgggcgacggctttgctgcattggatagtttcgtccaagatatcgggttgaataatagattatatttagctcgtgttaattctagacgaggtgggatctcttggtctttaatttccgggggaaactaattgggtcattttatagagattttaatcatttgtagagcagacagtcggcaaggcctgaagactacgcactgccaaaggtaatcggtcggagatgtaactcttcgcattcttttcgattaacctctccgatttgagactcgggcaagaagcggggtagaacagaataatcgtagccccttaaacctgtagatccggcctcgaatcgtgttcaaacggaatcgtgtgcaatttcaacaaccaataccctcttcattcattcatgtctcttagcggaaaggtatatgccgtgacgggcggtgcaagtggcatcggtcttgccacagcgaagctcatctcagaacgcgcgggaacggtctgcatcgctgacgtcaacactgctgcactgaaagaagtcgaggcctatttaaatttgaaatcaccaaaacctctgttttcagtgagccaagtcgatgtgtcgaagaaggatcaagtagaaagctggattgccggtatcaaaacccagttcggtcggctagatggagcagcaaacattgccggcatcattggagaaggccatggagtccagcctcttacggagcttcaagacgatgaatggttcaaaatcctgaatgttaatctaactggtatgatgtattgccttcgctcggaattgaaccacattgaggatggcggatcaatcgtcaacatggcatccatacacgcgacaactggtaagctcctttctcctctctcgaatcaagaaagcaccgccgctacaggatcaagggtgcgttgaatacacggctcattcaaagaatttctaaccgctaataggcgtagcaaaccatgctgcttacgccgcaagtaagtatggggtcttaggccttactcgcgttgccgccaaggaaaatgggcatcgagaagtacgcgtcaatgcagttgctccggggccaatctatacacctttgatgcaagggtattgggaccggacagcaaggccagctgatgctccctttgacgagcccattgcatttcaacgccaggggactgctgatgaggtagcaaaagtagttgtcttcttacttggatcagagagtagttttgttagcggcagctgttattcggttgatggggcctggatataggttgttattttgatttcaaaagaggaactggccggacagctgttgacaattattgatgttgcaaactacgtcatgatttagctctatatagcttctctctctaggctagtgtttagtgtattataatatcaaatgaactgtgcaactccttattcagaaatccttgtttatagctaggtttctattagttcctcacggcttccttgccaggagctgttatattcgaccgagtagaagacctccatgcatgaaatcagttttgcgatgacgtctattactaaacttcttctatgcctcaaagtgagctctaggagtactattttagaaataaaacagcctgggcattgtttagagccactttcttcaaaatctacaggttttggaactcgtggctcaacgatattccgtcagaggcagggatgcttcctggaaactcgaggtctcctcggtcccaatgccgcatgtacacgcccatgaacgcgccggagcctttaatatcttgcaacagtagctgtagatcctcgggcgtttgatccactaccgcggtaggttgtccatcatgaagttgtgtgaaggtattgacaaaatctttcccggaggggcggaacgtaacggcggagaagctcttacccacaatatcggctgggtctcgagccagtagatttccaagcgcggcacctaggtgttccatggttctgaagggttaggttcggtgtgtgagcgaatttcccgctgataatgttgaatgaacttggggactagatcgttaattacttacgtgataggagtccagttctttaactggttggcatttgccacgatcttattctcttgtaaattggttcccaaccatctgccatcagcgtcagccataaaatcactctgatagagtgcgtaagatgaacctaaaatttctcgattcaatcttatgaaattaggaatactcacccaaacttaaaagacatgatgaaagacccagtccatacatgggtgatacccacaccgagctccttagcaatcctctcagtctctaaaaaaggctccatgaatgaaaggtgagggtaatcatcatcagttaagggaatgctgaaccttgcagggatgaaggtgatgaatccaggggtcttggataaggcccgcacaaggtttatttgcaaatgaatggcggaaatgggaagagccgagcttcatttttatcagcatcatggtattcattccaatgacaacacgcaagagaaagtgtagtaagcttacattgcggcattcaccccacgaacggcctcttgaatattttcgatggggccctcgagatcaatctcacgtacttccacgcctaaacccaagtcaaggtcttttggcgggctgcctggacgatgtagaacaaccaagttcagcttggctgccttgtgagtaggtagaaggtgcctgagagccgccgaaccgacatttccgttgggtgcgaggagggcaacagtgtgtaccattgtgagatggtcataaaacgggcaagtgagaaaagataccaggatggcttggggaaaacggtcatcgaggatcaggaaatacgtcactatatataccatgaaactaacagtaaccacatgagtcaacttctatgaaatatagttaaagtcccttcgcatgtgacgtgactcgtctcagaacaccttgctggaataaaacttaagccatctaaatatcacccaactatggagaaactgaacaataaatgacttcaatatgtaagtgatactgcacagcaggggcttcttcttgccatttcaggtaatgtcaaattagagcctagcagatactctgtaggtggagcatctattcatgaaactatattagtgcttagctgtaggacagggatctcttcttcccattttcggcaatacttggcttttagcgtgatggcggctaaaacggtgacaaacctctgggcagctgaggcttacaaatacgtacctgctgagggtgttatgttatgtctgattgcaacagctgttgtttcttcatcgggtaagtagtcgagggtggggaattgaggaggcaacgatgaagatttatgtgagactacaagtgggagaaagtataaaggagatagaaccgacgtttggttgggtatagtcatctcacactctctgaacaatgagcccatgcagtactggattttcatctacctttcttcttaactcgttattacaatggcccccgattcattatccctccaaggcaaaattgcgatcgtaactggctcggggaaagaaaacggcattggtgccgccatcgccagagcgcttgctcgtaacggctgttccgttgccatcaaccatgtctctgacgattccagtcatcgggcggccgaggtagaagccaagatcaagagtcttggagccagagttgtcactattcaagcggacatatctaccgtcgacggtgccaaggaaatcgtcaaaagaacactcagcgccttcaattcatctaaaatagatattttaggtaagatatatcgttcacaggatttaacatagtggttgctgatcaagcctggaataagtgaacaacgccgccgtcggagcccatggcgtaacgttggacatttcgccagaagtcatggaaagaatattccgcgtgaaggttttcgggccactgttcatgattcaggaaacggttcccttcatgcctcaaggtggccgtattataaacactgggtccacggcatcaaagacaggcttcgtgcatgatcccatatacgctgccagcaaggccgcaatggatcagatgacattcgccctctctatggaggttagattccaaacgccgtcctgcccattcttagccagactcagaaagatgtgactaacaagtgaagtaaacagctcggacgtaaatatgggctaactatcaatactatcgcgccaggctcggtcaagacagataatttcccaggtgatcccaattctcaagcggtgcaagctttcatcgacttaactagagcggaagctagacccggcaatgtcgaggatattgctgatgttgcgttattgctggcctcggaaaaaagtcgatggttgacaggacaatacatctcagccagcgggggcgttacaggtggctgaaacaaaaagaggtttcggatctagacagactaagaatatacgatcgtttcttttcgcctgctttgaaatctttatcgatacttgaacttgatttttcttagatatacatcagcaccgccagggttttcatctgtgtggctgcagtacagcgcgcctgaaatctaatcggctgtcatgttgcctttcgcagtatttgaactgaaaacaattgccccaacatctaaaggaaggattttatcaacaaagattatgtttcttgccagttcaaagatcttttcaggacccccgatgcggagcttctcggctaggccgtcgatgtatgagacatatgctcccatgtgcgccgagtctatcaaggctacataaaccacacaccaaagctcaaggtccggaaactcggatccagagtggcaaaagagcagtattctgaatctctcctgaagataactgagctcgtcagtcggaaatgagaaagtttgtttgagccgcgccagaataatcaacaaggcaatccgggccatttcaatcacgtagtcgccggagtcgtcgtttttcttgcccattactccctttggccttggcattgataataaagaatgcgtaataggagttatcaaagatgccccttgcgatgaactgttccagaatttatcatcgtgagctttgtgacttatgaagtcgacaaggaatctaaaactcttgagagctccagcgatctcgtggtttccatatagtgttagcctttcaataacgctagttaatggagaggacattgtcccctcgggtgacggttctgccctgagatgtgcaggaatggcgtatctgggaacacaatcccgcgaggatgattcgagaacatcaaacctacatgggttagataattcaaagtggtaggggccaaattcagatttgttaccaaaatataagtagtgagatcatttgactaaggctttcaagccctccgcgggccttgacggctctttcgagaccatttaggtgaacggcccgacgatcccaattccctaaatgcgtctttagatatttagcaagaagtctatgtctatgaggtgtaggggaacaagtcatatacctcgtggcaggcaagccctaacatagtgtatatcaagccaggactaactcgaggagcctcactttccagtcttgtgataacctggctcaagcatacaccaagatacttgctcgactcttggttgctttccttctgcgtgagatggttgtgtaggaaggctgcattcgccaggtagaggtagaacgcagcggggtcggcagtagccaacgagtacgattcatgtcgaaatgggatgagatgaaggttgcccgcaacctgcactactgataatcagcatcgcccgaggcatgcgcgcagaagagcatactaaaatgaataagttggcgggccctggtgctcgtttcgacgggatatgtacccaaaaacgtaatatgaggtactatttgctgctgggggcgtttaaatagcgattgtcgacgttgaccgacgatgatggttgcgcttggaggaatatcaaccgatacggtcgggtttcggggtggcttaagtcgcaactggcctgccgctcccatagcatgacgacgaatcttgttttgagtctccttgtccttgaatccatcaggatgggatacatgaatgaaagaaaacgtgtctcgactatgcttcttcctcctagccatagtgaagagctctcctcgctgttctgattgtgagagcatgtatgaacaggagaggaattctgatttgtcatttggaaatgcagcgatacccgtaataggcttaaagcacccatgcatgaaatccggacccgcaaagggtaagcgcgtgtaagcagactggctctctatgtatataaacttattatttgctacatattccccgccccctcatctctctcttcttccttcttcacgagtacatataatatcgttcatttctctgtaagctgtagaatctagaccggccctttttgtcgaccttgttcagtcacgctagagactgtcattggttcctttatcttctgccactgttacattcatccccgaggcttacaggcgcaacaagatgccagagatcagcttctacgaccctgtttgccctgtgcccgaagctcgtcagaaagaagcgactaaagcgctaaacaagtctgtggaccaagccgatctagaacgatacccttacatcgacattacgtatgcctctcccgcgactcttgatggagttggagctgaccgtaactctcttctagttttggtgacggcggtttattcacttaccgctgttactctgattcggagaagaagatcggccagcagggtccttcaggcgcgtgcaagatttaataggtagtccaactttcagcggtgtagatgcatcaatgttatatcatctaaactaccgataaaactctgtgctttgctttgcttgatgtggtagaggccctagattaatatgggtatcgcaacgcaatagtttacaactccatgggaatgacagacggtgtccttgcaagagctaataaatagaacgaaacaacttcagctcgggaacttttcggagaaactaagtttattcatagaagttacgactaatacctatctaagtaaagtttgagagccttctgttggttgctcatcgattcactcatcatggagtgcgcaccagcaacccagcaatcgtatctccatcgtatggccccagagcttattcgcgccatattatgcagtgtagaaggccttgatgggttacgctgcgctatcttgagttgtcatttgttccatgatgtattctataagacgccgtccgccattatacatcaagtctttttcaacgagctggatacgcaccatgtgcgccgtgaagcaatcgctacgctctacgcctcgaaactcgccctagccgacccgacgatttcgttgatccaggccttcttccgagaccatttccagcagaggaaggaattcgacacccggctcacaatcgaggaggtggctggggcctcgagactgcacgctgtggtatccagtttggccgaggacttctctaagacgacattgccagaacttgctgcggcctgtggacaagcttctgatactctagaacttctagcgtctgagaagggacagataatgcgtgcgctgtacatggctgagatcttcttcgtcctcttccgaaccacctccagcagcataccagaggccgcacaacgtcagtgcatgaaagacttccttgttcatttcgcacccttggaagttgagcagcttgcttgtgtccatgatttcctcttcctcaaaatttctccaggtaggacagcaatcccgcgggtctgcaaaggctaacctatctaccactatttcacagtttcaatgatatggcagttcatgatgttctttggggagagtttcaggtagagcctgcactgtgctcggctcgcgtgagctgcaattctttctcttcaagggcttagttgctataaagagggtagcggcagcaaagacgtatgcggaacaacaaaagctcttcaacagcattccaggtaaccgacgcctcaatcttcatagagcactgaaagagttcagctacagggagtccaccatagaagacgctccgattcccagattcgcaacgtcggaagactatgagcaaggcccgtttgtaatgtggaagtgggcccagagagtagggcctctaacgaaccgagcgatgctacggagtttgggatatgtgatgtggaaccaggagcgtctcgacaagttgggtatcttgcgggagcaagaatggcagccacagcgcctagtcagagactctctacccaacgatagcccagttcatgaggtccccgatgagagatggctggcatcatggcaagagaggtcgcgcatacatgagcaagggggcacagggtggtgggatttcgatgatgagtcacaggttgcatggccaggatggaagaagagatcagctgccgataacacgcaaacatcgttggacgaggctaaaagagctatccttacgttgagacggatttgactttgtacttatccacgaactcattgaacctactggatcgatttcagttttcccaagacgcttggatgttggttgagtattaagttatgataagaaacaaagctaatataagataagcataaattacttggtataactgatcggtaatcatattgtcctgttgttggtatactaaatacctccaactagcagtcactgcctggaagcctgttacagagcggtctgcttagttacgaccgctctggaactgactttataaccagcccaactctgtagctaggatagtaactcaatcaataactttacaatatacctatctacgagcgtacgctttagaaaagccttccaacacctgtaaaataatggtttaacccccagcctttggacggttaatgagttccaggatgtgtgtacatgaccttcaataacatgaaattactatatataaatgcgcaacgaaattagagctggatcaattgatactaagagacacccccttaacggcctctttcactctctgaatcaagttttgtagaaaaaggtctgattcgggtagagatggaataatccagaagcaatgtggcaagccatcaaagtgttttgtatccacagcaactccagaagcggagagagcactactcaatatcttcccatcatcccgcaggggatcattctcgcaggtaaagatatgggttggtggaaaccttttcaagctctcgggatctaaaactgggtagtagttctggtcattaggctggaggccagcacaattatacatctctaatagacgttctttgtcgattatgggcactccttctttgtgtttttcgaatgaagtgtatagagtcttgtactccgttgggacattcgaaggatggacaaccaacgggcagagtgcgaatattcctttcactgtggctgtaggaaccgtagactggccaagtacaatctttcgagtaaccgctagggccaatgctccgccggcggaggtgccaatagtgaacattcgtgaggaacatactccgattttcttcgcgtttttgtatatctatattgtgcgtgctggtttaggattcggtttcgtcttttcaaatgttgcattcgggtgagactcacccactcaaagatggccaaggcatcttcaagctgcgcaggcgctttgtgctccggagacagtcgatagtcgacactgataactgcaatattggcgtcggcagagatcgtgcgacaaaaatcatcttcggaatccaaatcacccacgacaaagccgcctgagtggtagaagacccccacaggggcatgctctccctcaaaagagtttgggatatagattcggatcgcaataccgttgatactttcatctttgaccgtgagatcgttccaagttcgagttctttgtgtcgcgaggaaagaaatcagcccagagaactggtttcgcatctcctcggccgtgcctttcaagacaggccgagcgccccccatactctcctcaaactagtagctgtgttagtctctccaggttatcgtttcaggcaactccataggtgtttactcactttgtgccaagaatccaagtagacagccattatgtagaaaggatcagttgttttgtctgttgttgttttctgtttcatgagctggctttcagatcaccaatatgacttgaaataaatacaatttacaaggagggtatccagacctaatctgcttgttccgatcaccatcattgtagttggccgatgccgtctttccaccgggatctagactaaatatggttaatagcccaactgcatccgaaaacccacacgtggtacccttcatccgccggtatccgatggccttccggccagtgggcgacgaattagattttttgaggttcggatgtcatcgtgagacaagacatgttgagcatcgcactttgatgtttcagctcggatttgcaagtgcgttctcctcatacccggtagacagccggatcccacttctatcggcgtattgtcgtagtgtagccaaccttgatcctagtgacctcgtggcgtgagttacatcccagcagtggcgcactgattgtgtatcatggaagaaaagggaagcgccgattttcgatggcaccctccgtcatgtgcgtgctatggatctggactggatgttataagaacggtatgccgcacgattacgagtgtcaaattaacacttgtctacctgcagttcgcattgcatatcatttgcttctcgtgttgaaattgaacctacaaatctcccaaacttgtgtttattacatcatcactatggcctctactcccaacgaaaccgtgcttgacgctctcatcgtaggagccggttttggcggggtctaccaacttaaacacctccgtgatgctggatacagggtcaaactggtcgacattgccagcgactacgctggtgtttggtattggaatcgttatccaggcgcccgtgtcgacagtgccgtccccctctaccagttttctgacccggacctctggaacgagtggaactggtcacagaggttcccgggaagtcaagaactacgcgattacttcactttcgtcgcagaaaaatgggaccttcgcaaagacacagagttcaatgtctatatttcaaaagctacttgggacgatgagacagcaacctggacgatcgaaagcgggggagggaatatataccgcgcgaagtatttccttcttaacaccgggtttgcggctaaacgatatacccccgactggaaaggcattgacaagttccctgcatctgcatgggtccatccctcgtactggcccaaagaggagcccgacttgacagggaagagagtcgctgttattggaaccggctcaacgggtattcagttggcccaggagcttagccaagtagcaagccagtttgttttattccagagaacacccaatatggcccttcctatgaaacaagtcgactatacgaagcctctgacgaaggagaaataccccaaggtgtttgacggtcgttatgagagctttgggggttttgacttcagtttccttccgcgaggcactttcgacgatacacctccagaaagagaactggtgtacgagggattatggaaccagggagactttcaattctggcttgctacatatcgtgatatgttgtttcaggaggatgcaaataaggaggcctacaacttttggaagaagaaagtcagagcgcgaattcaagacccccgcctacaagagatattagcaccagagacacaaccttatagctttggctgcaagcggatatctctggagaatggattctatgagatattcaaccaacctaacgtctcactcgttgacgtcaactctacacccatcgtcgaagttacagagcgaggaattaagacaacagagaaagagtgggaattcgactacattgtctgcgccacagggtttgacgccattacaggtggtttgatgaacatcgatatccagggtcaggggggacataaaattgctgaaaagtggaagttaggggccaggacatacctcggtatggcgacggctggcttccccaatatgttctttacctacgggccccaagcgcctaccgcgttatgcaacggccccacgtgtgcagaagcacaagggagtttcgtcctcaaggtaatggaccatatgaaagagaagaaactacaaaaggtagaggcaggaaagactgcagaggcagcctggggcgatgacgttcgcaaatttgctaatatgtctctactcccatccacaaaatcggtaagtagctgccatgcattaatttcactcgtcgaagttaagatctaaatctaataacacctgcagtggtatatgggtgataacatcccaggaaagccgcgcgagtgcttaatctacctcgggggagtccctaactactacaactcactaaaggaatgctccgacggaggctacacgggatttacatttacttagtgagactatgttgctgttcggtagtcgttttccagtagtaataaggatgaagttctcgtactctcccgctcgggttgctagcgactctaaagtcaattaaacatccgctcctttgatgtctgtttcgtgataagtccatgcctgtaaagcagtcccaagataagcgatactttttctgagaaaaaccaaaacgcttcagatgtaagtgcctgaaaatagtagtagcggctcgaggctattcagagccgcagcaactactcatctcgacagcagacaggctggccacctcctcagctatcgcttgtcacagaactggtagatggccatcgaacaggtgatttagtgccagaaactagtcaagccttgacgttcttgatgaccgttttgacgaatgtgataggttctaagccgagtctaagttagtctgcatattagctgcacactattagcgccgttagacacacggagaaggggaggaatatttaaacccccgcatttcgcactttgttggcctccccccacattccccccgcaaactcgttcacccctggatcgtggtaactgtgagaagcaaccaacgctgagcgttgttttcttcattcctagctcctaatttgacggccctccagccgatcagacaacgactcgaatatgccaacaaggagagttcaccctgaccaacgacgccgctgcgtccgtgcctgcaccagctgcaagaagcgaaaagagcgatgtgatggttgccagccatgccagcgctgtgttgaaaggggcgcccattctctctgtagaatccccggtctgagctctcagccttcccgttactcatcgggtccaactctggatggcccaaatagcgagtcatcacatcagacaacagacacgagactggaggatccaccttcaaggctcccctgcagcccgagcaatcgccttctgtacattcctcatatttcaaggctgatgttagatcaccggggtactgggatgtttatgggtgacgcctcaaatatttgctttctgcaaactattcgtgagatcgtttctgataacttcggcccctgtggcctcgtcaacgactctctacgccattctatggtagaggagcccgcctggggagcctcccacgacgatcctgcactcgactttccaaagcgtccaccgaagccagccagagacgaagccgaataccttcttatctggttcaagcggacaacggaatgtgtcttggcacttttcgatgatcacaagttacaggaggatatattcaactggcttgaaaacccctcgggttattgtcattccacggcggcgttgcatcatttgatcatcgcccttggtgctcaatcatgtcctgaggacttcgacgacatcgccgaggcacatttccactacgggcgctatattgtgttgatgaggctggttgacggcccaagcatcgccatggtccagtgttacgccctcatagccatgtacctcttggccagctcgcgcagaaatgcggccttcatgtatctcggcatctcggtacgcggagcttacgcgctgggattgcataggcaagatgtttccgcgcttcacgatcccaccgagtacatagcccgcgagcggctctggagggggctcagaattttggataatttcatgagtgcgtctctgggccgtcccccggcaacaaatgagactcgcgatacacggtctggtccacattattccgcttccaacgatctctgctggatatttgagaatatcttgacagaaatctatgctaaacgcaatgtcaccactgatcgtctggagaacataagcgagctacatcgagaatggtcatcacggtttacgagtggtctcgagacggacgggatacttccagacatgcgtgtctatcagcagggggatgcgaccctaaacatcggacttcttcatctgaaagaggcatactactggacaataatgttgctctctcggccattcttagtggagtatgtcacccttcgattgaagcaaagacggacggagcaaacagatttcaccgacccgactagtacttctcggcagttttcagcctcccatgctatactggtccaggcttgtattgactcagcaatccgaacggccaagttgctccaacccatgacatcgtcacctctcactcccaaaagactcccctatgttgtcaactcggccttcgtagcagccttggtgcttggattggccttattttctgacctagatgacaccgaacccagtatttcctatatggaagcttgccacgatgtgctgctcaagtttagcaagcatgatgccgtggcgaaaagatacctgttcatcacggagaagttacaagaagtctgctgtgagaacttgaagattcgacaaaaggagcaaatggagagcaagggtaaaatgttgcatatgatcttcgggagcattgacaacattggctcgctagagcaccaaacctctcctagtcataggacgtccgggggtggtgcgtcgcacatcctgtcccccgagtctcagtggagctctgaaatgccaacacaggcaacaagcttgttttcagaaacaacaagtgctcttgtcgataagggaaccgggatagaaaatgcgaacgacgaacaggcctggatatttagcatgtctgatgacttcataaactcggacagccaagtcgcggatatcgtatcggctagtaccctctggctagatggagattgtgagctcactgtagaagccggagataactgagccagagaatatctgctgagaaataatttaaaaagttgagattaatatgaagataaagatttctataatattcttaccgttcttagtatgaaaattcaagccattgaggagagtgggccattaacaggggtgttgacttacaacgaatccgttttcaaacattcacccgtgcctaggtgtgaaattagtgctgatataagattccagaacgaatgggttcttggctgctcctctccttgattctcgattcccaactataaatttacggtaacatccccgaccactcgcccactgcgcttcttccattcatcccatatttcacaccacgagccaaagtggccctcaagatgttgtctgggtcattgtcctggctagtgccgttcttcatcggcgaggcagcctttctagggattttgattctccttctccttagaactacagcgcaggctactaccaaacgagttctaggagttgcagtcttaggttctgtcacctattttctagaatatttggttgtgcagatatgtctatccaggaaccggccactttgggccggcactgccggctcgctggtttggattcaactcctcagtgcatcagacctgatgttggcgcttcgggtcgactcctcgaagctaccacctagccaagcttcaacacatgccgctagtatcctgtggaacatgcgtcgtatcggcacgcggtggcaggtaaagactgctgcatcgacgagccatcagtcccgcgtcggctttatcctccgccgcgtcgctactacactgggagcctacctcgttgtcgacttcctcgtctcgatgccccccccccccgacccctcgctcatacaagtcagcaaagcgactctgttctcactgcatgaactacacgtcgaagatgttatcttccgtgtttctatgaccattggattttggatttcggtcggcgttcttgtcctttgcatgaacaatctgggtgcaatattcgctgtggtcttgaatatcagctcgcctgaagattgtctaccggtgtttgggtcattccttgacgcgtttaccgttcgtcgcttctgggggtaatgttactccatcctctgcagattgctgtgctagaatattaaccttgcttgcctcacagtgttacctggcaccagatgttcaggagcttcctgaccggccacgctgacctaattgtcggcaattgtctcccattcttgtcccgtcactcgctgatatcccggtatacgagacttactattgccttcttcatatctggcgcaatccactaccgtgcggaccagctcatgggcgtcccaaacagtgagaacggtgccataatcttctttatgctgcatgctcttgccataatggctgaggatagcattgcgccggtaatctctgcattcctgcccctgtcgatccgtcgcgtcttgggcttattctgggttttgatcttctttgtttggtcaactccaacttggagttatgccaataccagggtgggcaatgatgctgccggcttgctgcccatccggcttattggaccttgggtagcgtattatctgaacgcaagctaaacgattcagtgcatacgtacctaagcaataacatgcctaggtatgttcgaatcgttctactgcattcgaaattgagaagggatgtaacgcaaagaggaagaacaatacgcctacgcaaacatagcagaatccttcgattactcgacaatctttccagcagatgtttccaatagcacgcaataattgatgatatagaacttatgattattgtctcatagtacgaatttgctaggagccacagagtcttttagtgaatactccaggcagtcggtcagagcaccttgatttaccccatgaacactcttatgttcaattcatcgttttaagataccaggttatgacatctcctaatactcttccatacagtgtgctggttcagtcccttttctccgtcacttgttgtgctctgccggaatcgcagcgctttcaagtctgtcagtatgcttgcgactttcgtctccgtgctctacatatgtacgcgtgttcgtacggtttcaacctcaacagccctcaatggcgttatgagaccataagaagaggaaaggaaatcaatgtcatcaacaaacaaggcatgccttaaaattactaaataaaaaaaattaagaaacccgtctcaccgggcgctccccgtgaatctcggcggcggtggtactggcccaggcctcggccgactcgccgatgagcatcaatttaatgcccaccggtttaccagccggggccggcctctcctcctcttcctcctcttcctcctcttcctcctcttcctcttcctctccccccccctcctctcccccctcccgctcctccctcaccccggccctcccctcctcctgctgctgctcctgctcctgctgttgctgccgctgtggctgttgttgctgctgctgttggggttgttgttgctgctcctgcttctctgtcagtgtgtgtgtgtgtgtgtgtggcctcttctcctgcggacaaagagggaagagaaaaaaacttgcagccagggaaaaatggatgttttattaaaaactagtttgcttagggggaccttactcgaagaataagtttccttcctgaacatctaacagacagtaggtgatatgggggcttctctcaacaagctccttcctcgccaatgagcccgacatacaagcaagcacctaggtactccaaaagagaccactacctgctacgtaaggccgataaaccggtactgagaggggtcctcttcaaagtgtgttcccaacttgatatcacatggcttcaaggctttctgatagtaaagtgcctccatggcggctttttccataataaggcgaactagctctttgttcttgggtccatgaactatacccactaccgccgtgatatactctctcgtcttcattatcagttgttcattcattcccaagtcttcaccgtatcttattgttcggcaggcgaaatttgctctcacagtgcagcagctgcggatgttatgctcgacagcgattagatcaagtgtgcctggatcgagtttgtcgagctccttgcggacttgcaacatgatgacatcaacactctctaaaacccttcgttcctcttgcctgcggatgggcttgaaaggtgtgtcgtgaagatcttcgtaaaggggaaggaagggtggagggccatttggatggatctttgccccagcatcggattttttgggcttggcatcggccagtttctcggtttgtttgccaaatcgcaaccaggaaggaaggaaccgctgtatgccggtctcattggaagtccccattgtcgttcaggcggcgccactgttcgtgtcgatgacgtacttatcagttgtgttcttgtgcagatagaaggagcgaagacaccgaggcgggataggttgagggaccacgcccaccaaccatatgaatgaggcggaaggtgctttatgtgcctgtagaaaagcacaaattcatcatgatttgcacagcagcctctgaaagttgccgctaattgtgtatgtctctatgagttagacggccaaggttcgagccttttgccctagctctattttttgtggcgcaagggacactcgccaagaagcgagagcatctacctcgctcccaggttgaaagcccggagtatctaggtaattcggcgtgggtacgtaggtactcgggtcctggcacagttgaggcagttgtaagggttggatgcgtatctcctgaggcatccaatccacgacagaaagttgaaggtacctaggagagatggcccaccagatcacatggcaaccctctttctctgttctactggtaattctattccccccttcatccggctgtcttctcatcagtctcctctcactcaagttccgagagtcatcaagtagacttcgccgttgtcacacgcaaccctcgccaatgccaatcttctcgttgctacaatatccatcacgaaagcgtttgccgcgcctttctccaaccatggcagctttccaaagcgtcctttcagtcattcgatgagctcgctccgcctttgcatcactctaggcgttcacatacacacttccatttgagcatcagagagtcgatccccatgattctccaagcaaatccctcgccctacgtgctccgccgctcaacagagccaagcctacccttcctaacgatggtgaattgaacggaaacaccctccagtagccgccaaacgagatgcgcaaaaagacttttcccaaagcactgcaaatagcaagtgatttctacctatcgcaggcgctcaagtgacattgccttgagcaaaaccagtccattccttgctacatgtggtgttggaaccgcagttatttaaagtggctgaagtgtgttgtgtttctcccatgatcctagcctttcattacagattctaactttttgcaggcattttgggtttggtttggcccgtatctcgcctctcgccactcggttctcgtctctcgtccgtcctctcttatctctcgtccatcgtctctcctctctcctctcttcagtcgtctttcttctttcttctccgcctctcagctctcgtccacgcctctgcccagtcggctatcgctcatcgctcatcttgggttgcttgttgctcgcccacacctctgctgagtcacttgacgctcatcgttcatattcggctggttgttgtccgtccacgcctctgctctgttgctaatcgctcatcgcccattgtcggttgctcgtttctcgcctcatacttcttcttctgcagctaagtaaactctttgtcagtttgtgtgtgtgtgctgtgtcaagtgtgtgtggtgagtgttcgtgcttcgaccatgctgtcctttcgtttgtggggctcctctacttcttcttctacttctacttctacgtctgcatctatatctacgtctatatctacgtctatatctacttttacttttactcatacttatacttcttcttcgtctacttctacttctacttcttctacttctatttcttctatttcctctacgtctactcctacgtcaacttctactcctacgtcaccttctactcctacgtcaccttctactcctacgtcaccttctactcctacgtcaccttctactcctacgtcaccttcggcacgaataccatcatcgagaccaacgaaaaattctacgtttccgctctgagacatctctctttgggacctctgctgttggacggccacccagtgccaaaacgacgagcagcgcctcaccttcgtccagtccgttcaaagaacaatcttctcgcgttgaacggccaatgagcaatgcactacaacttaattccggtctctgtacgatggcaagattatgcagttccgcattgcattacgactcacttcttgagctctaagactctaagttcttcccggaccgctgctgatactttcgcccaacgggtacttttcaaggagatcaaggatgatcaaggaacttgcatcacggaactcaccgtgctctacggaactttccatcattattccatttatagctacgaacaaaccaacggacgacagcttgataccaactcgcaagcatctggtgactcatacgctgcccacttagaggtccacttgatatcacctaaccaagtactcgggcgtgaggttattgtacaccttatcggacaagttcctacttcactcagtctgtggtaaccagatacctcgccgtcaataccttggagcacaacaacgaagtagacttagcttccccaagctagctttcgggccttccctccatgtcaatgccatcgcagggctccatgccgaggccaactacgagctcgggaaaactcgtgattcttgtgacgggacacgacgaatgagagagagtgtctatggagatggtctcacacaagcaagatgaaacttgatagtcagttgatgtggtggcggaactagaagatgctgtctggcaaaggaaataataagagacacaacgcgcaggataactcactcttttatgaaatccagttgtgtcaattctatattggagtttgaagatccagtggccaaaattaagagatacctgttggttcatgtaccaaagcatgcaatacaattggagggagggttgaatattataattccactctgcgagagacgaagctgtatctaagtctcaaaattcgacccgatgttgatgcatgtaaatcaaaagtgatttaacctgaggctgtgtatgaaggtgtcgccaacgttttgctactacgggcaagtagatcacggtgttgtcatgttaagcgttcctccacatcgagccatgattacccgttggtgtatacccacatgaacacgtgaatgatcttcggctgtataaacctacatggcacttatgtggagtgcagggtatttttaacctggaaaggctgtatgctaccggcacagtcaatttcgaaccccgggcgtgtattctggttatacgcttagccctgttacctcgtgggtttatgaagggggagaagaggattttctggctccttgctggatacaggcctccagctagtcatctggtgaggctttggtcgctactcgaagcccttgatatttattagtagtagaggcttagattcttcagattattatcttaaattagattaggtagtcataagtggtatttagtaaatgaagtaaaatacacaacacccaacaaatccagacggcccaaattatgaacaccatgcttccattaaggggatagtgttgcagaaacgggttcatgtaccccttccattacatgtgtcaatagtgtttcaattattaacgataaaatatacatgtctgacctgccggcagtgcttagacttgagagctcttctcttagatccaaaagctaatggtgggaaaacaaggccaacagagcctcgtcactaatttcatcaccccaagatgctatccgtgctttcattatccctgtgcgctcgagtcttctccggcttttgcatgctaatattcacagccattccgtcggcgtccaagcttttgctctgagaattctcgttccctatgctgtggagcttatagccgcggctatggctctttcgcgaccagtgccccgtcgagatgtcgtggccaggggtgttggacgcgctgcctgacgagagccccaatatggtgaggagcttgggtaagtaggcccggaggaagggcttcatgcgcatcaagttgctgcacaagataccaaggttgagctcgaccagtgaccaaacgccagcctcggcttgccttcgagaaaagtttgggtcggtggccatgattttgacgtatggggctcgagcgacggaggcgagtaggaccctgtacagagatgagaatcagcatgtttgaagatacgcgaggatatttcgttagaaatacatacgcagaaccgaggctcatgatagctccagcaacaaccttcttccggaaaggcatctgaagcttgtagagcgttggaatgggcagtatgatgatggacagatccgtcgcgatattgagcacgacctgagaaattgccagattgttgaggcacgtgccaccaccgacattcttgggattgcaaggaccggatagaaggccagtgaatgtaatggtatatatgaggagcatcccagacacaatatacacgccgaggcggaattgttgtaccgagcttattcgccaaagtacgcttaaaatcgaaagtttgctcagagtcggactccacatgtaggttaacgttgtcggcagcaagtactgtatctctagagtcagaaaatgaagacaatttctcgattatttcatggtttacttacgttgtagtatccagtgaggtcgttgatgctgatatcccatgcgtccgatccccaaccatatttcattgcgaaacagaccgagataaaatatcccatggaacaaccccatgctaatgtaatgagaactagatttccactgctgttagcacggcatgtcacttggaggtcagagcagcattttgccttccacgtaccgacatcggcctccagggcccggaccactgcaacgctcgtgacatatcgaatggccaaagacgcagtcgcaaagaagtaagtgacactgaacactattatagtggccaattggaccgatgagataggtcgactaaagtccgaggtcactccgtccggcggttgtaacactggggtcgtgtatatatcgacttcggggctcagggcttgcattgtatcggtatctgtaggtctccctctttggcgccaaacatctcagagacagacttgaagattggcatcgattccacaagttagctgccaaatgtgtggcagcatacctatatattcctacatgttgaacaacgtggacaaggttcttcctcgtcaacaggtctccttagccacagggatcccatggtatatactgtgtgaaagtggcggatcaaagccggcccttaactggagactgaaaagctcttccctgaatgtggatgttcgacctcctgacttgggtgtaagccgcggaacccgtagctcttagcccctacataccgagtacgacaactccacggcattgcggcatcaattggataatcacgaaatcaaacttgaccctccttttggccactttttaatgatccaactgaattaaagcctgcttacagagtacggcgttccggcattcaccatcaccaaaattctctttgttggttgtatgagagtctatcccatcaaccaatcacgttccaaatttccaagagcagggtacgcacgccttatacatattacgtggagcagtttgattattggcaacccaggggcaaatatttatctcatggtattcattattaccaacggttcgttctcaaacatcccctggcaacctggcccagtcagcttaccacacccttaccctgctctgtttgtgctaaaatggcgggcaatcatgccacataaggaaggccgaacgttaacctttgtcgtttaagggtagctctcccttcttttagcctggattcggctcctgcgtcggcagttgtggttcaacaggtctgtttcgcattgggtcatgtacgccctcatatgagaagaaagttaagctactccacctgagtgggtgctggcaacgaagctctctctacatgctggagcccatcgcgtataacatcaccgctacttgtagcccagtccaacttgctactggacaaacgtaccctggccgcattttgtcgttcctgttggtcgacatccggccttcatgcgggtcacaaagtcgtatgttatctatcggggttcgcccggtaccctagcagtgaagctgtaccccaggctattacaaatttcatcggttcaaaaggagtaataagtcatcatctccccttgtgttgcaggacctcggccaactctgacaactcgatccaacccaaagtcgccaagatgctcaacacattggccaaaaccacgaaggctcctcggagcattttcaactctgagaaggcgttccctatgacgccagaagagatcacctcggagtggctctctgaagcattgggcgtgcctgtcaagagctttaagatcacgaatgctatccatggcacggcttccaaaatctttctcgatctggaattccaggatgaagactcgacccgggaaattcccagcaaggtttgcgtcaagggcggattcaaccctgtcattctccaaactgtacctgagatgtgggctacttatcgtcgcgaggcggagttctaccactatattgcaccacagaccaacatgttacttcccaagacttggttcacaggcacggataaggtcaatggccagggcatcgtcatcatgtcgaacacggcagaggaatgcaagttcggcatgcccttggaaccctggaccccggagcttgttgagggggctctgaagcagctggcgagccttcatggaaagacttggaataggagtgaagaggaatacccatggctatttggcaaggatggagtcaaattagagaacccagttcgtaaaatcgtgctcgcgcttcttcatcctgcgccatggggtgcacggttcgatgagaagtgtcgtcctcccgtggctgagtctctgcttgatcgagagcgcatccagcgaggtttcgaggcgttatggaagcacgcggatgccgatctcaagttcttttccctcatccatggcgacgaccacatcggaaacacatttattacaaacgacgggacgcccggatttattgattggcaaggtctgcagtatggtcctgctatcctagaccttgtctacttccttgtcggggcaatgtctgtcgaagaccgccgtgcacatgagggacatctcattgatagctatctagaggctctgcatacagagggaggacccaaaatgacgcgaggggatatatgggatgagtatcgtcggtatgccatgcagggatttctctgggccatgacgccccaaacaatgcagcctgacgatgttgtttttgccatgagcgaacggtactctgcagcgctggttgatcatcagacgcttgagcttctgggagtctaagtaagtcatgttagatcacatgtagtgaaatatgcccatcaaacggccaacccttgctagatatgtttcgtaccttgagctacgctgtgcacttggtagtaaaatcctcacaaaatcattaatactccaccttatagtgttaattgtcttgattttttattgatgatcatgttaactattatattatgccgaacctggctgacggtagccttcggcgtggcgtgttttctatactcgaaccaatgccgctgatttattgcgatggtggtagcaatatgaattacaccatctcttctcaattcatgtagctatcacatgatcatccactgaattcagaagcccacgtacgagctttagcattgaattcttcatagattaagccttcaagtgcaaaggcttgtttgttcccttacctttgagtaagtttatgtagtatatcctagacaaggtctaagaaaagtattatatagttaagttttgcccggcttccgtgaatgtccagtacaacatgacatgaagaaggtttgcggcgcaacctctaaataacagacaagtaaactccgttttgtcaactcttttcccgtttagtttgaaatttactcggagattttttcctctgttcattttcttccttacacataatctcgtcagttatctctaccacatcgtttctcaacaactactgatattcttttggatcccttgggaagaactttcattgaaagtgttgccaactgctccccccaaaaggaaaagtaaactatattccactatctcttggattctctcggccactttccgtaacttgccatgtcttcggctgtttcccccggggccgcccagcgggctgccattctcggtggttccaacacggttgttggagccagacttgacggcaagggagactaccatgggcaggtaggatctcctctcacagaccaatcgcctcattccaatagtgcatcaagtctcgaggatggttccgatttgcctctggtagcaaacacgttttccatccccactgacaaacaccggacatgccactgggccgagacggcgttcctgatgatggctgagttcataggttttgccattctcagttttcctcatgcttacgcgactatgggttgggttcttggaattgctgccacgctcttcgtgggccttggatacttgtacacctcgctcgttctctgggatctttgcctccgacaccccgagagcaagagcatctgtgatatcggcaagacattatgcggaaagtacggcgccatgggattttggttcactgcatgcatgtttgtttgtaacaatattgtgagtcgatgttcttataccttttggatttgctgatcgctaatatcttgacgtaacagtgggttcaggttcgtgtctccccccttgatattgcactctatttaagtcaattaaccttctctttcagggcattcatgttaatctcggtgggaacttctttcaaaacgtggtattaaacggaaagtctgtgggcatctctgctcggatcctcggcggcctcgttgcaacttttctctgcctcctttgctccttacctcgaaccctcaaagtattgtcccgtttcgccatggccgctgtcgcttccacggtcacttgtgtcatccttgccatgatcttcattgtaaatcagggtggccctgttgactcctcagggcagaccgaaggcagtgcggatgccgttatcgtaaagggaaggatgatcgtgttctcagcctggccttcacctgacgcaacctttaaagatatcatggtggctttcttgggcattgcatttgcattcatcggccagataacgctccccagcttcatcgctgaaatgaacgatcccaggtttgttgaatcttctgtccttatgaaaatctttcaccattaatatcttttacgcagagatttccccaaggcattatatctctcctcgttttcccagtactcgctcttcatcacatttgccctctttatgtataagaacatcgggcttcgtgatatgacagccatcacaatcggaagccttgaaaggactcaactcataatctgtttctgtttccttctgccttctttgattatactcggatccctctacgccacagttaccggtctattcatcttgaattcggtcgaatcacacatctcaaagaaacgtaccaagaatattatctgggtcatcattatcagtacgttccattcactctgcgcaaacctcagtcgattttaagtttaactgattttgcttcagctcttctctggggcctagccttcactatcagccaagtcattcctcaattcgatgcttgtaagttgcttgcgtcatctattttccattctttttgctccgctgaccatcctactctgtagtgctcgccattgtcggtgccatctttgacggtttctttaggtggatttattggggggtcgcctagttccgtatgcggcaagctgatattcaaaagagggtgccccgcgtatgggggccgaggatagacgttacgttgggggtcgtcaacatgtcgctcgttcttatcggcatgggccttttccttggtattggctcttgggcttcttttgcttaccttcgagatcttgagcacaacaaaaactgacagggaagagccgagctattagactacagtcattggaaccgagactaagcctgacagacacgatttcgaaactgtatacgtcgccatgattctctctatctcggtctattctcggaggcggaggagcaccaacttcaaccctagaggatcaatttgttaaatgaatgtgatcaggcgagcaagatatcaactgggtttagtgatcaagaaagtctagatccttatagacgcttcttacctggttaggctcgacgtggtcatttgagatatcattaaagtccagatcaataggtatcaaggttcaagagaagcaacgtggaaggattcataagccatgtttttagtaatatcaacacattctattcatgacgattctggggttggttttttctctccttccgaaggctgtccgccttggctccattctagtggccgaacgcgcataaactcgtccagcacggcatctgtgatggtggtgcgacgctcctgatatgccttgataaactcctgaagcttgacgatacacttctttttcagctggcctgtgagcagtcgacccgcgatatagtcttggcgaatctcctcaagctcatcgtcgtcctccgaaaagaagctcaggtactggaacgcaacatcaacgtcggggttgccacccagtctgcgctgttcttccattgtctcttgaccgcccgagaaggcgtacttattgatcttcttctcactatcattccagcatcgaccagtcagcaattgttcatgaggggccatgaatagggggcagtatatggcgatgatatgatgcttacatttgcttcattgtgtcattcataaagatggcactcgagtcaatcgaggcgctcatcttggaaccgggaccctggagcgcggggaaaaactttgagtggataaggcagggctttgggtagcccagcttgggagcgacgtcgcggcagacgcggaagtaagggtcttggtcgatggcgcatggaatcagcgatgggatcttggctactttcttcgtgtcggtgccaaatatgtgcgggaaggtggtagcgaaagccgtggccgactggacagagacgtagtggtatttaccaacgctatcacttggggggtgtcagtaaacaggagcggcctttgagggttcatcatatcccacctgtcagtaaatccaaacaccgccttgctagtgttctgtgtgatttggcgggaaatcttgactacattctgataaaaggcgccgcccatgaagtcaaagtcgctgaagaggaaagtctttttgacgtcgaagccaactgccaagatgtcggtggcattgccgcggacaaagcctctcatttcctccagactgaacaccttcttgccgaagatcatcttctcgtcatccgtcatcataatgaccaaggggacatcaaatacgtcctgaagccatctacgggcaccatgttagcagcgattcccctccaaaagacgagtcaagaaccaacttggtgaaggtaaagggcaccatgtggcccagatgcatactgtcgctgctggggccgcgacccgtgtatagaaagaacggctcacgcttctcatggcgtgtcagaatccaatcgaggtcgcgatgggagaaaaccagttgacggcgaagaaacgggtgcaacttgtgaccggtgactcgctcaaagcgctctagcagcgccttgtcaatgggcttcgtgccaaaggtgtcgaccaggcgattgtagtcgatggccttgaccttgccgtcgacgatctcgccgctgacgctccatggattgacatcctgggcagtcgctgcgttgctgaccgaaaggtcggccatagctgaattgacggtatcccccatgccgcaagtaatgagtgctggtgatgcgaagccgctaagagtgtcgacaggcaatcagatgtgttgtgcagagaagcatcgcgggaaatgtagagttgagtcacgtttgccctcatcctgaagtcccacctatctctgattcgagcctctgattggcttggctcagcactacccctccagcccactatgacaatgaaaagtgccgccatcagttgaagttaggtcccggggcacgtgatgacccctccatcatcagccacagcgattagccactctccgccacacaccgcacttattatatcgcctgggtctttcaccttccagtctacatttgcttcaatcacaagcaggttataagcaatagcattcgtggctttgatgatatttgagtgctcaatagtgctcaatatcccgtcttccacattgcgtctgtgagtaatgttgtagccagctcagggataccattaccgggtcgaaatatacatgtataccgacctgaatatatattttattagaattgagcctaggttctggttcaagcattccgctttgaaacccagaccgaatatgggcctggcacaaaactgcttcgggaattatacacccgatgttcccttaatcaatcgagcaaaagcatcccaacgccccatgtggaaacgttacagtagaatcttgagtttctgatgttctagatggccgattcagctcctctatgatgaatcgtacagtaaccaatatgcatgcagcgcgcgtacctaaggggagggttcgcaatcctacgcaaataagccagagatgtatgagttgcgggtctctttcttaactccgctactaccccagagacaagatttaagtaaaagtagactagtagacttggcacatactgcaacatgttccagaactatcaaacctggtgtctcctctcagagcgtcaacatagttgaaggtaggctgtgtaacattatcagtctaaatatatcctatgctaactttcaggcatttaaataggacggccatacgccgttacgcacctcaggtgctgcttttacagaggcagtcaggcagcggttttacgcgaccttggagaactacgtgatttcatagaagtgtcctctcccaacagatataaaacgcaatctatacaagtcaaggtcaggttacggcttccgcgtaccggctcaaagactacagtggaaagaaaagacagttaaatatttctaacatcaagtaaactcctctttgaattgagaacccttttgggttgaatctagtggtggtagggacgtaagtgatgtagtatgtctaggtgcgaggatggccgttcttggaattcttctcttgcggcttcatgtacatcatgatttataggcacctgcccaataaaaatagtgtgaaaccagcgccatgatcggccatgtgaaggatcttcgtagcaaatatcgaattggcaggcaggggtgagattcctagcaagccttatttggagttccgtgctcctgggatcgacaataaaacggccctgtttaagctaaatatgtcagacgttgggccacagccacgacccagtgcgtcacctcactctagtttgtcgtggagctgatcggaaaagacggctccagacccaagaactagcaatgattaagaacgagatcagcatgcagttaataattatccgccccctggccatttcccatcggcagaagggggataactatgtagttattaatgttaagcgccagatttatgctcatcttccaattcagcatcatccaaatgtatgtcgaaataaatattgatgcggcacttagcgactatagatccggccacagggctagtcgggtctgctgtcctgtgtgcggtatggacccaatggcaatctagccgcagagatgaaccctgggctgagctgatctgctggaccttgcttccgatattatgcaaggctatcaccttgcccatcaatcgacttgatgcagaaaaggtaaccgagtcgcagagatcacccggcgcgtggttatggttattttcaatatgcgtagcaactcaagcagtatgtgaaggagaacagggaagtaactggtttcttgtacgtgtaaccgatttagatctagactctcagtcttcttgtctaacctttcatagccgctgttgatgcctcttctcttggtcgtcgagaagtaccttgggcaggacctatcatggccagcctctttttgtcccatttttattttcctgatttcgaatacactgccgggcacaacctcgatagccctcctcggaatttccactctcattgttttcaatttgattcgctttgcgttgtcgataacatcagcggtggcttccttcacaatatacttgacgctgctaaacaaaggatccaatcgttctacgcctattcctcacatcaatattcgagaggatatagaacctctttcttttcgggtggcttttactctagtcgtcgttttggccttaaagaccatcacatttgggtgcgccgtccctcaaatgcttcccgctatcacgctgggcatctccaaagctttcacttggttcttcttgattcaaactgtacgtctcttttacccgtgatagtcaatatattgttctagctgctgataaaggctaaaaggctcatcatactacatggcggatcgcagtaccaatcacggccttcagcatcttatcaacaactgacccgtattctcaatcatgggatatcgattccttctttgtattggtcggctcaatcctgtttctagcccagatcatcggaacaattcctaaacacccaaaaactctctggatactgtctctcatccccataattccataccttctcagtctccaagccatcatgtcgagtcaacacatggcaaggattagtttccacaaccaccagatgcaccccgtggaagaagccatacatgctgcgcaggatgaactcaactccctcatacagcgacagtccagaacctacaccgccgcgcgcgatgaatacaaacgccggtatggctttgaacctcctccaggctttgaagaatggtatgaatttgcaaagacgaatcagtcaccagtcatcgatgactttgacaccatccaaatatccatcgctcccttactaaaactaagtggccgcgaagttctggaagccatgagccaggtatattcgcggcaagatagcgaagtatggtcctgtgaatattcatcacagaagtccgagacgcactgcagccatccacgacgtacattcgacagacatatatcactcttgtttaacagggtgatgaaagatgtccctagcggcgttcattccatcaggtttcttgtgaatcattttgatgagccaagggtcctgacaacatgcaagcctcttagaaaccaactaccacaccaagtagggagtttgggacaggagagaaatggtgatgaatccccaagcaaaatctgggatatgatcagccaaaattgcaacttccaagacctcgaatcagaccgatctgagaactggtcaacttcgcccgacataggcctcgtccgaaaccacagccaacaggttgacatctgccaacacccagaataccaacacatgcacggcctcctcacaaacccagtaacctttcgcccaatccaagatcccgcccccatcctctcgacggggtcgctctccaccatgggcgacatcctcgtacccagccccgcctacctcgaggaagagttccaatacgacgaggcacaggacacgggctgggccagcaaacacaacaagctatactgggcgggatccacgtcgggcgggtacgcaaacggaagccactggagagacttccaccgccacagattcgtaaacatgatccacaacccggcgcgagaccagaagacatactggtacctacagcagcagagaaacggactagtcgagcgcgtcccctcgtcattcctcaaccgccgattatacaacgtcgccttcacccgagtcttccagtgcgagccgtccgcctgccacgaccagcgcgcacacttcaacgtcagaccgtgggcgcaaaaggacgaggcgctcgggtaccgactcgcattcgatctagacggcaacggcatcagcgggcgcttctacaagctgctcgcgtccaggtctgtccccctgaagcagaccatcatgcgggagtggcacgacgacaggctcgtgccctgggtgcactacatccccgtgagccaggacatgagagagctgccggagctgatcacctacctgacgtcgaccaagtctgggcaggagcaagcacggaagattgctgagcaggggcgggattggttttcgagggcatttcgtgaagttgacatgacgatctacatgtatcgacttttgctagaattagcgaggctacaggatccgaccagagagggaactaaaggagttagatgagagtatacctggtgatcttcagccctaaatgataacgttcttgattaagtaaatgaggccagtatttcagtatgctgtgaacttatgttgctttctgatcatagaggcgtgcgagcttcaagatcaaagagacactaaatgtgtttgtctcaagccgctccatatacgagcactcactctggatatagcacctgcagccttgtggactcattcaaaaatgtgcagatatatcgattgcaagtaacatgttcactgtagatagaatagaggtcacggtatccctaatcctttctcctggtatcatcaatataatctttggcttccaactgcccgccctcgttcatatccttaatagctctcctctgattaaactagtacaaatggccattattagaattagaagattcaaaagaggaaccaatagtcatagtcctcattgggtttctcgagtcgcaccgacgatttcatgcgcgcctgcgaaccatatccatctgcaacctcgcttagaccctctcaacagggctggcctcagcagcttctgcgctctggacgggctggaggttcttctccttctcaccgtacttggcctccaagtcacccgcctcagctcttctagtagctgaggtggctacctttgtcttccaagctggtgtgccgatgtatgggattccgttggggtcttcgaagatgctgctgacctcctcgagagtatggccacttgtctctgggaagaggaagaacacatggacccacctacagtatgttcagctatatgttccatcgagatgaaggtcttggtgattcaagaaatagtactcacatgcaaacgttgaagatgccaaagatgaggtatgtcttccacttgatgttggcaaaggcctcgggaacgaacaggcccaaggcggtgttgaaagcccagttaccagaggtcgacatggcaacaccctttccacgaagatggagggggaacaactccggggggtatgtccatgatgccggaccccaggtgggggcgaagctggcgacaaagaggtacacggaggcaataagcgccttcgcaggagctccggagacctccatagactgtgccgcgacacctccaatgcctccgggaatcacccttccgtagttggcgagaattccagcaccgacgaacatccaaattcccatgaaggttgcaccaaccaacatagtgtttcgtcgaccccatctatccatcctattgaaacgtattagacgctgctctccttctttcatttgctgaaggatataagaacttaccagagcagtgccgggattgtcataaagacgttaatgacgtactgaatactagaagcaagcagaacagcatttcccgtgtatccagccatggtgaagatatttgcaatgtagtacactagagagtcagaaggacgtggaggcctgggtcagcgttgaaattactcactcatgacattcataccagtcagctgtgaccagatctgcgtaaagagggcagtgactgtgcgatgaatcatgcgtggcttgaagaggtcgaggtacgtagcatctgagtgctggcgttcaaactcgcacatctccttgatctcttgaagctcttggttgacgaacgggtggttggggtcaccattgccgtggacaagggtcaagacgctgtggcagtcctcccagcggtccttacgagccaaccaacgaggcgattcggggagaagcatcatcatgaagaagaggaatacggcggggagcatctgcagaccccaggggatacgccaggatgctgtcttgtaggtgtcgtagtcaccgcctccaatgaaggagcagccgtaggagatgtagtacatgatgaggatgccccatgtgatggcccattgctggaatccgatcagacggcctctcatggaaggctttgcgatttctgcaatgtagacggggacctgagctgactcgattccgacacagaatccattgatcatgcgaccgattgcgagctgggggatgttctgggacgagcaaatgatggcggaaccgatcatcctggttcgctgttagtcaatgaactgaatcaattggcccaaacatcaatggtttaagaatattgaatcaaaccaagactcgctgtttgcttattggattgccaagggagacagacgggtcctaaatctgcaagcccacgaggaagtgaaacagacggccgccatctggactcgaggcttggctgccctctccgcagactgtgccaagcgtgtccatctcaagcaaaggcagaaagaggaattgcgacttaccaaataacacagccagtcatgatggcatactttctgccgagccaatccgacaggaaaccagaaaccaatgcgccggcccaagaaccagccgacatggcggcagtgataccaccctggacaagcgattcggggccgctgcacttcttctcgtcattggcctcgaactctggtggcgggccgttggggccctggttgaagtagcacaggtagctctgcatggccaactgcgcgctcagagacgagatatcgaatccgaacagggcgccgccgacgacggccacgcccgagatgacatagatgttgccaatcgccatgacgggcagctgtaggagtataggtttgcgctctctctttctgggggctatctcctctcttctctaacggaaaaagagggaggaggaattgaagaacaagtattcgcagtatgtaaggtggtttatcaaggcctttccctagccgagtagtgtctcaggatctcgaggggtgtgagttgtgtgtgtgtggacagctcggggccatttatatgtgcatgcacagacgcagacaccgcatggctgccctccatcgaagcactggactctcccgcggtggcacttccaatgacacgggtaaggatgatgagaactgatggcttgttcccccgactgggtgggaatggcgatccctgcctgtttgctggccgtggcctggttcccccgagcaaagcatcccaccatccccatcatgatacctacatacttgggtttaccgaccagcgatgggattggggaaggtgggaagtggatctctatcccctctccgctgttcctttccagtggcgcatagacaggattctcggtttcaattgccatcttgctgcactgctgtacgtcaatcgcgccagaagagcttggcctcgtctcagtcttgccgaggggctgaagcttccaagcgtcgcggatggacgatttgcccgtccaagtgtaagctaaatctaacctgcgtgcttgattacccagttgagatatgattgaattagatggggtatgacaatacacagtcatgtaatgccagtcccattacaaagaaaagacacgcagagcagcgtctatccgaagtcagtgagagagtcctcgctttctcacatcggccaacatggactgtctccagggaccatcatccccgcacattgtagcacctttcaatcctttcggtcatgcgaaagtgagcctcgtgccgtgaaggaaaaagcaataatcgaagggtgccttgccacgcgcatggtcagatcccagcaacggactgtccaccaattggtaatgtgctgctggccaagctcaaccattcgcttaccgctgctttgtgggaccggggatgatcgtcggacaggttgctatgtacatacagcttgcagcaaggactgtgttcaaggccgagcatttggccgtctggctcgcgggacgctcttcatgcccgatgacgatggcggttccgtttcaagcaagccgggtgcgggcgtgggaagctacagctcccattcaagtcgattcctgtggacgggattcacaggctagaagtaggatatcattttttactgtctcatttctcgataaagcaagacactgcatgcagatctgtgatcaatagatccagcgttgctatcagcatcgtaatgacatacaaatccacagccagaacgactgcagaagggattataccacacctcctttgcctagccaaactccagtctggggaacgaaaacagagtatatggatgggagatcagctagaggtgggataagcacatccacttccccagtccccaggtcttttcattgctagcacacctgaatagacttaattgtgttgttgaattacgggctctgacgatgagcagccaattaactcggatgtcggccacccaggaagaactcgagcctgatcaacgccagagcttctctatgccgacgctgccgtgcctcccacctggtcccctgtcccacacgacacttccccctcctctgcgcgtatcaattatccataggtagaacggcggtgcaccatctggtcttgcttcacagccttgacagcctagaggtggctttcacggcctacgacagccaagcctagccccagtcatcccgtccaccgccatggcctaggatcagcagccaatgacgtctatccccgtccggggcatggaccttctgctctcagctagctaccggatggatacctgtcagatattttctttggaagctttcggtgaattccatccaaacctgggggcggggctggacacgaggaaacgagatggtgtggtgtggtgtggtgtgtgcatccatgagcatgaattcagaatcagaatagcatggcagagtcggactgggaatttagccaaccaagcatgaagctctcccattcctctgtacgcgttggatgctactcgatcccagaggacggtgggccaggtatagctctgattgggggcagcatcgagcagagcagagctgcctgtcatgtcatgtcatccaacgcccactcacatctgccgacatggcgcacccatgctgtaaaatccccgccagtgcagggctgtttggacgtctggtgattgtccccttgatcgaattaagttgtcgttggtcattccaagacagcggccgcccggactctaccggccacggcgacggacgatgggtcaggaggcatcagcatcagcatcaccgtccagcacttttcctccacagtaggtccgatgagacaccggctgcttccccttctcgatccgcgagcgaaggggtgccaatcagtgcaacgtaagagatcaggtggatgtcggtctttttcaaagcttatttccggacctcaattcgattggagatgatctcggtgcagccttgggcggtggcatgatgctctctcgggtcagaagcagcgagcagcgagtttcctcgccgcccatcaccacgaggcccagcctacgtgataccgctgcttgctctgcataacccagccagagccaggggaccgcgtctggacgagagctggggctgacactgacactgacaggcctgtgttccggtttcagccattcctcccgcctcggagagagggatcgagatcgacagctaaatacacaaatgaatcacatgctggtgcaaacatccaccatcacgtaatgaatggcctggcgacgaagagataaccatcaggcaaaccatccccagaccagcaattcggccttatttgggcataccacggagatggagaacaatcccacgaggcaacgcaaaccattctcatcctgtctcatctcatctcctctcctctcctctcctctcctcccgcccccctcgacctcaaccacgttacatgcgcccagagttgcatggatgctacctacttttcccttgctcaatgcccagttcatgcccccctcaacccgtccatggcccccagcatccgatcatagccgttgctttgattataaactccatcgtgcggttcttatcccggacccggccgccagcgtgcacctcctacctggacctacctcacaccaccgctcccctgcgctcacaaccacatcccaagtaacaaatgcgggggtttcaacaggtaattaaaatttttggatgaatttttccctctctttttttttctttttcccatcccgtggtcagacacgggccacccccaaacctgcctcccacgatacgtcatccggcttcattagccaccaccaccaccaacagccaagcatttcctactcttgtcccatcacatttcccaccctgctcccatgtgaaaaactttgctgcgcagatgatgtgtgtgcatccaggttggccatggcccaatcttaaatgagccaatctttttcggaccactttcgaaacatggcacatcgtttaggcgcgcctctcccattgcattcatgcccttgtaagccagcccacccagccgttgaggatcatcgtagtctagttagtacaatgcagtgaaatagaatgaaggtagtggacaatggattgttgtttagagtttcgactagctgccccaagtgtaggccccgtagctcccaacggcaatatcatccgcagaatgatgtctacctagtgatgccaaatagatgaacagtgttctctgtttccgattccatgtatctaagcgtgggggaaatctcaaatcacacacaatcgaaataagtagaataattgtacatcgtaattcaaggtaaatatgcgcgttaagctgcttgctagctggtgaacccagcatcatcattctacccatccatccatccgccaatccgctcctcccaagagttatgccctgacgcctcgcaatgcaatagaagaaggaattgtccatcacacaaaacggacctcgttgaacaagcttgctctcatctgcatcaggcttgccacctcgaaaacaaatgattgcaagatgaggacgttggtgacgacgtgcgataccgaaacggtcccgtcgttgatgaccacgctctcccgcccgagatcctcatcctcatcatcgccggttccatattcatccccgataccatcgagctcctcggcacccggccctatatgcatattctcctcgtcgtctacctcaatcgtatcatcaggttcggacagagcctgcttgttaaatcgcaacgggattggttcaatctcctccctatgagggagaccgactcggcgggctagaatcgtctggtccacagctgcgaaatcggccatgcgactagcatgaacgccctcatcaccctcaatatcatccataccatcatctccgattaagcttggggacaatgtccttggtagagcccctttgactggctcgtgctgtccgagagtgaggtctttcggggctggaatcgggatcgcttttggactcgccaatccgtagttgtcgattctatgcgatggcgtagcggctccgctcctcgtccccatgcccttctccttccgccctttggggctaccggagcggctgggggttcccagctctgagaagatacgctgcgcaaagccttcaaacccagatggacgcaacggcgagctacttcgcggtgtctcctccatccaatcagcttgcaccaacttgggcgtctcctttctcgaaggaacgggggtgctgagaaccctatcggccgtatagaatgcctcccgtcgttgctgcagcagctcttcaaaccttgggatcatctctttataaccatcaacctgctcgcacaagcgcttgattactgccaaaaatcttggcacagaggacggctcccaggttgggcgacgcctgcacttgcgcatctccttttcctgctgtgcctcgtgttgttttcttgggtcccgcacctctgtcgccttttgagatgtcacaaccttgggcctgctatcaagcctcggctctggggcgctcttctcagcgctgtcgttgccttctttctcggtttgctccgcgactgtctccgcctctgtttgctcttctttttgcccttcttgttcgagctcctctttctgtgcttctccctctgactcttctttctgttcgtcttccacttgcttctctttctgctcctcttctacttgtgtcggctctccttgcttgtctgggctcgagacaacttccgggtttctaacatctatttcgacgtcttcgacgtcctcttcgtcctggtcctcctcttcctcatcgtagatgtagttttccggattgcgggtaagccatccttcaacgctcatgtagccgcatatccccaaatccacaagactctccgtcacggaaaggttggtttcaacggggttcaagaagaaagactccaaaaggtcgagcattgcattgagaagaggatcatcaactctcaaggtatgttcccggacttctcttggagaacccgggtgctcgttccggaaggtcgcctctctgcctttaattttccctactgggggcgccatgagcggaatggagcatgagtggctttcaagtctcgacttggtatccttcagtaagtcgtcatagagatcattgaaattgtcaaaacccccgatagcaccagcaaggttcacgaggtattccacttcctgatcatgggcccctattgtccgctgaagagtgtgccctggcaggatttccgttcgtagtaatgtaataatagcgtatcgatgatgtctcttaagaatcgccgacactagctgtagcgtgacgtgtattgtttgctggttccttgacctcaaacaagctaggatcagatcgaccaggttgaagaggaggggggtgacagtgctgtctgattttgaagccatcatggttgctagatccattgactttcgcttgcgggcattgcttattgatgttgttgagctggacaagtcttgggcgggttctgtatcaggcagagcaagaaggtagtggaggatgaggtgaatcatgtccgggtgatccagagcctcaagaatacgtcgtagatatgtcaagacagccaccgaggacccaccgtcaatgtctgaagattcgagtaaggaaggatagctatcacagtcagtcagagggtctgcaaggtatacctaaagtttaagcttacagtaattgctggaggaagatgacttggaaatgctccaacagagtcgatttgacttcgactgacttgcaatggttcaaaacatcctgccaaaacaaaaggtgggacaggaatgtctctaggtgggattggaactccggggagcaggagctgataatttcaaaattggatgtagggtgttggtaatcggaaaatgcgagaatcggaggaagattctgggttggataatcaataacgagtttccggctcagctgactgtacagggcacctagacccgtagccatcagggttgacaggtcgctctcaacaatccattgctccagcaataccgaacgagaggccgactcgataatgtagagcaaaccggtgcgagcgaagtcaccaaccttgccctcatggtggatataatccatcagaatgtagaaaagagggaagtctgccctttgggtccggccagcaaatttatcacgataatcgcggtcgccttcggcatatttagggtcatcttcatgtgtgttgaaccatgccggcaatatcgcgggatcctgccgtatctttgtggtgatattgaacgccagctccacgacccgagactccgtgtcgagcccgaggggaacactattggcgcccgtgatgcggacaaggagattcgtcaggctggttgagaatgtgtgtttctccacgaaagcttcctcctcgctctcgatcaatgtcgcgaaaaagaggaccgcctcctttataatccactcattatatgaaatgatcgcgatcttgccgatgtggacgtagatttcccgtaacgatgcaaactgaatgcagggatgcggtagaggacgacggctttcgtcgctaatgatattcgtgagctcttggagcccaatctcgacggtctcggctgcatcgctgtcgcgggagatgttcgaagtgcgccatgtcgcctgtttggtcacaaggtcagctaggtacccgtctgtatgtattatcggccccagttgctctctagcagctcaccaacagtttcccgtattgcttttcgaaccgatgtagccgtttcgctggatctttcgcctggtcctggcgggtgctctccttggagagggggctcagtaggcgggaccactgtgtcgtgttaaccaagagcctgtcttctagtcagaatccgcttgctcacaaagtccatgatggctctattttcatctcagcagggagatgatcatgagggagtaagctggcctggcgccagatgacacgttcgcatggcgcacacgatacgtgcttcggttggagggagcttgatgtctgacttgacttgcgacttccaagcatccttggcataatgctgtcaggggagccgtggcgtttgctagagggaaagccacatggggcttgtgggcttgcggtcttagctaccctagacatcatgacgccatttacgaagattaccttcaacgcctgttaatcaatgagaaaaacatatgttttattttaattgcatgtgttacttactattatcttaccaacattccgtcctaaattctcagtctatttgttttggtactaatatcgtgtcccaaagtcctaataccgattattagggctacaatgaagtatgcacatcaatgccgagcgcatagacatcattcatatattttatgcgccaagagggcaagggaacaggcattacccttctttcccctttgtgccaaggaaaatcatctcctccagcactgatagaattgtgccatacatcttattatttccaatccagtggaaatatttcatcacgaatttcttaaacattgagcctactagcgaagacggagcgatacccttctgtttgagtaattggccttttggcgatcagagggagttattcttggccccacgttttgggcatcgcccttttaaactccctagatttgtatatgcgttactctcgtgatggtgccatataattatttttcttataagaaccatagaatggattgagggattctaaaacctgtacccaaaaggaaaatacaagttggatacaggaaaaaaggatacaggaaaaaggagatatataggacaagagcagtaccggtgatacctttttgtgactgcacctctctttacttgagtgatattgtcaagaaggctcgctggaacaatgaatatttgtctgaatttgaagatatagatgggattatattcgagatcactggtaacacatcttcttggctgacgaactagacctaagaaacgttctcaatgctgcgctggtggtgtagggaccggggtgtcgctgatctcgctcgaaagactagaactcaaatatacagtatagtgttaagccttcttgaggtggcttctagaactgaactcgaaaatgattacttattgatattcctaagtcgttatcttctggaagcagtattctgtattcgaaccagattgacaaggtgacagtcattactgaagctaaggcagagagaactggtatattattaatacttgatggagatatcaattaggatttacaataaaaaccaaagtacatattagttaataaccagaacggtaaacgctcgatccagctagagccataagaattcctagttgtggatgaacgcctccggaattcatagcctaccttggctgccctccgtgatatactctcattaaagagactacctcttgtcgtgatctaactgttatggaccaatattatgcgagtctgtccacacgatgctgcctgaatcaattcaatgcatgctagcttcctataagcgagactcatcaatgcagcattgcagatactgaacagtgaaaccggaccaatgaatttctgcaagaggcctcctgatccgaattctcacgggcaacgattacgacttctcttttgtccaatgcaccatcgattcctgagtctaacaagcgaggaggccattttagaagtggccgcgtcaagtaagctttgttggttgcctcgggcgcttcctaaataggcgccatctgcgatgcttatctgcaagtgaccataaataccgtaaatcaagggtcctggaaaggtaaccgcctgccttaaattgggatgcggatattatcaaaggatcaattgggcccgaaatagcgctttgcggcagtgagtgaaacttaacgctaattttatggttgttctatcttgatctagactgggttaataatactttgcatcttgcgtggcaaccaggtgagctcgcattcgcttgcattttgtgcttgctcaagtaaaaatagacttggaacttgatatggagggcttctagtatgtctcaacggaagagaagaattataaataccgaccaactgccttcagaatctgagccggtccctgtatcaactcatcacttcactgataacctttcggctactaccagttctcctctctataccattttttaacgaaaaccaaacgaatacatactgtcctccgagaattcttgttcagaatgcgtttcacggaaattctcgcggtcgccactcttggcctggcaggctctagctctgcattctctccctctagatacagagatcttgaaacccgcgacgagcatcaactacgggttgcctaccaacgcagcttagatgggcttgagacccgccaaccagcacgtctgaaaattggtatcctggattcgaagaaattggagaagctgagaaagtctgcgaagaagaagacgactaagcctaagaagtccaagtccaaatccaagaaaccaaagaaaaatgcaaagaagatcaaactcaagggaaaacctgctggtctgaagactggtaaagggggtggtgatggcacgagtactgcctatggaaacggcgatgggatccccagcactgcctacaaccgcaggtcgattgagctcgagacccgccaaccaatgcctctcaagattgggatcatggacaaagagaaattggagaagatgaaaaaggctataaagaagccaaagaaaacaaccaattcaaagaaggcaaacagctcaaagaagtccaagaagtcaaagaaaaaggtaaccatcaagaagaatgctggtaccaggactggcaaggaaggaagtttcaatgagggtccctccactgcctaccaaaatgtaggaggttctagcactgcctatgactaggccgaacgtgacgttcagagcggttttttttttttcaattctaggctagtatttgagcaaaatatttgccatgtatctcatagttttgcacaatttatcgagttgtcgagttcttccacaaaccatgacaagtctctctctgttcaagttagctttttggtcacgatgttgcagagagatgtgaggctgctcctgatccactatttacagcctcgggagttactccgatgtgcgtgactaagcattaaaaaaacagggaaaggcctggagtgcaccgcgctagctcggtacaggtactagtgactcatttccctcagtgacgaaccttgaaacctaaagctttaaaccaaacaggtaaagggaataaagccttttacgtagtccataccaaagggtccaacaaaaggctcgtttgtcatcgtcgcccgtcgctgccggcctcgaatgttatctcatttcgttggataccacctgatgctgcagcttacactgacaagtactggtactcgcaatccttcaaggggcagagtatctctttgaagcagcgggagcagcagtatgtaacttgtaggggtttgattggtgtgttgccatgagaaaattgtcggnnnnnnnnnnnnnnnnnnnnnnnnnnnnnnnnnnnnnnnnnnnnnnnnnnnnnnnnnnnnnagtacctgatagtactcactgtactctgtaaaatagcggggaaatacattactgctgctcccgctgcttcaaagagataaaaataatccagccgactcctcctgcagcccctcaaacagcgagcacaaaaagtgcccaccaccagtgcatgcgctaatcctaatgcgactattctcctgcacccccaaaagagagtggacccgcgaatcagccagtcagcatcaatcatttattatgtcgatcgcagctgctggtacgagcttctcgtcgagaactgcctttcctgaccgacttttaccttgccattctgggtgttgtgttgcatctctcatctcagacctttgctcactgtcaggttacatggcgactcggtttgagtcaggtctctgtcattagcagctatatcaagactgataatgctcgctgatcaatgggtcaagactctctctaaggcaacaccaagactactgtgctgggcttgctgggatctccgactccacctcactcgcattgccagagtcctttgatgcactcgtgatctacccctctgttccaatctgcatcattcatatcatcgccttggccgaggatatccacagcgcggcaaatccatccacgtattgacgctgctgctgcgctgagacagtccatctcgcagcttacaggtccacgtatcacgctcgcgcttcggacgaaggtgggttcttcggtcatcagaatgcaaaggaaccgtcttctttgattagaccgccccaaggtgacattcgtaggcgctctatgatgtgcagatcagaaaatcgtcgcgcgaatttcctgccaactctggctggccagagatttcaacgttgcccagacgagttagcgggcttcggcactctactccatgggctggtgcagtcactttagcggcatccatcacagctgaatgtgatcatagagatggagacggctagtacttggcgagtatggtgctgcctgccagtacatagtagacaggcagcgacgggcagcaggccggcagacaggcagcaggtacgggtacgccgtgatgtacctgttattaggacggccctagaagcacaaatctgctccacaccctcattgttcaagtgccggacatggcggcagccatcgtcgtctgattgatgcttgtgtgggagtgcagatggagggcagatgtatctccctgcctgggtatgatgtcgtcttgctcgcatcatgctcggtcaggatgcgagctgatacaacacacgggcatccactcactgcacgtcctcggccaagcacgcgcgcacatactgcactccaaaggtgcatctgcagggaaaacacgtatgtaggtaagccccagtagcggcgtcagggcaggtcagagcgagtcaacgcggggtgggggtgctgctgctgtttattccagtggaccgaccccggcgatgcgcataacgcatcatagaatagtgcagcgattgccttgtcagccgacgaggaaacactggtcgccattccgggggggggcagatcaaactcgtgctgatggggctcccctgggggccaagtgcctgcctagccctggccagtacgtggaaattttcccttgaggtccactgaaacgtgctggctctccgcctggacctgctgcttggccctaaccttacagttgagcctgcactggcgacagccaatcgatttgcacggcttggggcatcgccggctgcttgtccaatcccagcgcatccccgccgcctttattcccgttccggttgttcctgatgccatgtacttctactgcactctcccgctcctcccaaaaatctcacacccagtctggcctgcttgcaccgtgcccgtgtcacgcacatcgactaagccgtggcaccctccgcagaaatcctaaaagcccttttcttgctttcacaaccgccagccgccgcagcaacccccaacccgcctcaacgaccatcaacggctacttcaattgcgaggcctgcacctgacggtttccacactcgtcggcaggcttcttttttgttgttgctccaccatcgccgcatgtgttccaggtccggccaactccccgcacacgattctcccaccgtccacgacttccgatttgtcgaatcgcgcgagccctcggtgcggtcgtacgcccctcgctcctctcccacgaggcaaccgttgtctcgctgttagccctggtccgatcgtggcttttggggctaccaagcagtgggcagcagcaatccagggcatatgcctcgcggagtaggctccagtaagcgaacgtcaggggccggtcagcgcgacaccaggcatgagaatgggcttgtcggtccagcaactgcgaagcgagccgtcggaaacaagaactccgggcagtatgagggcgctgcgaggtctggggctgagaatgtcccgggccaagcaggtctgccctcacccaatgcccacaacaacggctccgcttaccagcaccaattaaatgggaatggtaacaccaagggttcgagaaatggcaatgccaatggcgacgctaactccatgggcaatcaattgagcaccaggcggacctcgcttggaaccagttcggacgagacatcatctgaatctggtggctccaacatgggtaaccacagcggtggtgccatggatggccttcatcgtcagattgatgttaatgccaccaagaatttcgacgtccatcgtgactccggccctcttgagcttgtgactaccgtcttgaagacattgccaattcacgataccctagctattctcattatcctcatgcacgtcccgtccgtgtccctgacgtttatctacgcaatattcacctgccttacctttgttccccccgtcaccaccagctctggaatgaatatcaactttgccgagatcttcgacggcaactcgaccaccccttcacctgtcactgtcatgtgcatggatttattctttcttctcttctggctctttctttggcaacccttgcaggacatccttctggactttgctaagccgattatcgccatcacgcttggcggtggtagtggagcaagggatggctcttctagaggtctcacttcttgcttcatctgggttgtgttccatcatgtgcttcgaggcacacgcctgcattggacacgcttcgtgcgccacatacccgagaacttgcctattccttccaccctgcaggatacattcaactttcccaccgagagttacgatatgagatcgggcgttgggtgggtgaaaagtgttttggctgtgcatatattaacccaagggattgtacgatatgtcaaagagtggtatctcaggcgtgagaaggtgggagcgcaagccaatatgagtgatccagaagccggaaaatccgccggcggctcgaacgatctgtcgaccgacgctggattctcgacaaccgatgctgaagcaggtattcagcatgcgcccccaccgccgcccaccaccatgagcaaaaagagaagaaaacaaagtacacaaatacgcctacaacagccgctctgggccgctctagcgagcaccaagattgtggttatgaaggagtacgaattgtcgcatgcaactagcgagcaggctggctcgaacgcgaccgatgttcacaacctcggaaacgcaccgttcgagaaggagccatgccacatttggatttcatatgtcggcagcgacgaggtttgctttaacactagccactttgaggacgacgatgaagacgacgagcagaagagctgccaaggagagaacggagagtatacctcgagccaggccaagcaccctcagagacctctgtatgtccgtgtcaacaacgctttctggcagccgacccgcatgttcccacttgagaagcaatccgaggaccaggtgggcacccaatggactggcgacatttatggtctccggcctgcctccaagtatgtctgtgaatttgtcgatcgtcgtaccgatgaggttcttttcaagaccaccattcgtaccgttcacgagccgcaaaaagagacagatagtggagcacctagcgcagccaatggacagccctctcttcgtcctgattcacctgccacaactctgaaaacctctattcaagctgctgaatctagactttttgacgagagaaatcgcctcaaggcatcccgcaaggaatggaagagccgaaccaatgctttgaagaaagagatcgagttgactgatcatcagcttgcaacagctggtaatagcgacgagaagtttcgacagaaggttcgccaacaagagacccagaaatcgcaggcagagagagacacggaggccgtcgcagaacagctgaagaaatttgacaccgcccccgaactatccgatcgtcggaagaagcttgatcgccaatatggtggcgaaaaatccatgtacgacgttgccaagaaagagtacgaggagttcaagtccaagctggagaaggaggtcaagaacacgggtctggaaaagtccaacctggtcagcaaggtcaacaagatcaagacaagaatcaaccgggtggagacggagctcaacaacatctcggacgccaatgcccgtgggttggatgaggtccagcgccgtcaccaagagcgtcttcactgggaagagaacacgaacgccatcgaggccaattaccaagagaggttgaatcatatccaggcgtccaacgtgatcaaggttgaacagattagagctctcgaagcccagttggcaacctttcttgaccctcacggtgcaatggctcttgatcccaatggcgcaatggcactggaccctaatggcggaatgggagttgatttggacacctacgatgagcattaccagcagcagcatcttcaatcctggaacccaaacccagctgctgccccacatgtccccagtatatggatgtcgtcgtctgaattaatgccctctatttctgccacctctggtgttacctcgggctggcagcctgcaatggctcccgctttcgaaccgtccaaaggattcaagtctcgtggtcgtagctctagtatgctcagcgatatcagcggtttcacccagtctaccaatgaggaggactcaccaccaggtcacagcctgtcttacggttggaatgcgaacacattcacaccagttagaaacacaggatatggccggcgtgacgagaacaacagtggcggtagtgggaatggtagcgtttctgcgagtcccagtccttgaaggatgtctgagaaggcaatcccgattgtgtcttgtaggggttcagaaaagcggttttcgttagcaaatacaattatgtgctatttcttcttactagtctctctctcatatttgtgacgatgtgaatcccctctgtacaacttttgtaatctgagccacggtgagttcatcttatatttcatacaaacgctgtctgtgtgcaacctgtacgagggaatctaaactctgatgcgtgatgctaaatgtacacatctcatttcacgacctgaatgagacaacaccttggaaactcctaattcgaaatgctgatgattcatgtgcctctcgtcactttttatatacaagcaaaatatcaaacccccttcactgcgacccgtcaacggggtccttcggcggactcccatcgccggcctctcgggcctctttatcctcctccgccccggagacgtcgtcctgacgagcaggccgcctcgtcttgatccccaccttggtgtagttgacgaaccggtccgccttgcccgcccacgtctccccctcgagcttccacagctgtgcgaggatctgcgtcttgacgatccggcgcgccacggcgcggatccccgtcgcgtcgtcccccgccgtctcgagctcgaggtgggcctgcaggggcttcatggtcctctcctcgtcgttgacgcgtagtagctggtagtcgacgcgggcgttgccggcgtactctcccttgccggcggtgtagagctgcatctcgcaggtgacgtggccgttgcgctcgtcggtcttgagggctgtgaagatgtcgatggagaggcggcggggtccgtttatggtttcctgtgatgggatattgttagggctgaaggggagggagttggagagacgggggggagacgaacggtgattatgcctttgggggatgggacgcttcggacgatgatgtagcgatcgcggagctggatgttgtcctttgagaagcctgactcctcaatctttgctttgatgtgctcttggaacgactcgtcggctagccggaggatcgactgtggtttgattataccgccctgggaagggtgttagcaagaaacgtcgaatcaaacttcctgagtagcgagagggaatgcaattgggtgaaagatgcgactgacatgcgctacatccacggcctcgaacaagtcctcgtcccccagcttggtcagccgcctcgtcctcgccttctcggcccactccgtcatggtgatcatcttgcccggaccgccagagttggcaatgtgccgcaggatctcgcccaccctgacgatctggccgtggttgaggcccgaatagacgaggacgccgaggtcgtggtagaggtggcgcaggcaggggacgaccagcttgtcggagacctggccattgtgaccgatggggacctcgacgaggcggcgggggcggattgagcgccagtgccggaggctggggaagatctggagggcgggcgggaaccgaaggcctttgtgcgccattttgagagtggaatctgcgtcccgccggccttgtagatggcggggttgaggcttggattgaggggtgttggggtatgggatgtatttttggaggatggcgcgataaggctgagactgagcgatgtggctgaaactgtcagccttgcatattgtggctgggaagttggtggcgtcactccggatgaggagaaagcgcacgccaatgatttggtcggtgatcgctccagtcttcaccctcttgtctattttgtacgggctacagtcaattgcagggatgcagccgccctgtgtacaatgatacctcctaacccagtcctgcgaaggcaggtgatagctatctacaaaggttaccaagcagcttgcccacccatccatgtgctgtgcgagagctgacggcttctcagagcttctctaccttggacgagactatcccttggggtatgattattttaggcctcggcttcacaaggcctttatgagcaaggcagaggagcgggacgatgaggcaattaagaaaggccttgcccatgcagagttcgtcaagaaaggtaagtgctggattttgaccagccaagtcacttggaagagaacactgttgacgatgcgacgatagagattgaagccttgtaggtgcattttccatctatgtatttccctttgacttgataatgcctgatagactgttctactctggatgtcacagctgaccctttccgcagatactacttgaagcgataccgcacgctgcgaaagcgttatgatccggatgcatgagagcttgaaacagtcacaccataccataaatagtcattctagataccatcgccatctgcacccaccaaatcttgaaccactccgctaacggggattcctcaaaacttatccaaaaattgcagtagaaacggaaaatgcaccctttgacccaaccgaatgcccgaggaaaataccaaactttgggaaaggggaataataaccaaaacaaaaaaccaaatgcagcaaatgttagagatgcttggggagaggagaacggtgggtataatagatcgtccgactacctctttgtcgcccaccatgcccctacttctaggcattctccccagctcgtgccgccttcgctcatcaaatcgttcatcatcttgcccatccatacgtcccattcatcctggctcttgccgctggcctcgcggaggacgggttccagcgactggatctcctccaccacgatgctcagtgccattttcctcagtgccgcctgtccggccgtcagtgccttcttctccaccttctggtgcgggccccggtcacccttcatctcaacgtaggattttccgtcccgggtgacgacaccgccgacgccctcacgctcccagcgaacttcgctaagcgggatggctactctatgtgagttgatttctttgagagcctcagtttcctggagcaggtagtggtttaccacagtgcagggcgtgaccaggagtgaacgctctccagctgccttgttgatccagttgttatactcggttaggaaggggttgagtggagccgacaagggagtgttgagattgatcatgtacgctccgaggctagaagctatttcttgctgctctgcctgcgtaccagaggctgtcggattgggcacgtgggggcgaagcattctaatgatgtgatcactctcccagatttccaatgtgccaccaggtgtgaggacgcgaatcatttcatcgatcaatggcgcgtgatctcccatggttatcgagagcgtcatgtccttgtagaaaacgaggtcgaactcattgtcagggaagggccagggctgacggatatcgtgctgcacaaaggtccaattcatgtcccggtccggcttgatcgagtcgtaggggatgttgacgctgccaggagccaatggggcaatgtccatgccggtgaattggagattggtatgtccgcggctcttgaagtgcctgtggcacatcatactccagaaaccggacccacagcccagctcgaggactttgacaggtggcttgactgagagtgaaggggcacacacgggagcgccatgaacctggataaggagcagagtccggagagcttggcggtggagttccgtgagatcgattgggaggggatctaccaggctggggtcgttgtaatacgtccggccattgcgctggacgaagggttttgggttgttggcggcatttccaggagcctcgccggaggcagagttgtcggtcgaggtgacggtccggcctgataatgctgtgttgatactcgtcgacgagacggactcggtgcgtgagaatgatgacgagttattgacaagcttcgagcccgaactcagggacgacttgttagactcgacgtcaggaatcatggcgacatgcttggggatctccccggcggagaaggcagtggtccggggcgagacgcctggcgatatgactggtgatttcagtaggctccgcttggtggtagcgaagaagttggaggtggaagcactgaagttggtgaagtgatccgaggccgtcaatcgcttccgcctgggcgaggtcgccgaggatagggaggcccggggggtgtcaggctcgtcagagacaaaaggtggctcgaagtttaaagtgccggcgatgctggcaatgctggtgtcggccgatcttgcgtccaagtccggctcatcaaaggccgcttccgttgagagatgccgagacaaggacgcagacacggcggtctcaggtcgatctgcactagaggcagtcctcgactctcgcgggagagctgcgtcgaatcgcggggtcggggtgtcgagtgaccttcgctcgagctgcttgggcttacgacgagatggagggcgggatggagggcgagacagagaactactgtcagagctggagggaggagagaaggcggcggcggcatgtgagtacatgtattccgacattgtggttggttgtactccctccctactacttgcacgttactttagtagcgtggtagcaagcaaggtgggaattgggcggcgtctacctactctcctgacctgatgagctgcagtggataattacagtctaggaagagctagggggaccgactctggcgcccctgcactggatattgatcgtattcatactagcattggtcgtggtgtccggaaagttggaggcggcgccagcctaacatgggcacaggaagacggcgccgaactcaagagcgtgccaaggaggtaccgtccgaagcctcttgcaggggaggggcttgccagcgcaaagcaaatgattgattgagggtgcgagggggggagaaggcctgggtttggggaggaggtgattaattcccactaccgcgcaagcccaggccagaccttgatcaacctaatgcctgtgcaggtacatggcgcagggcctgtagcggacttggctgggagggatggcgctgcgaggtaccccggcggcaggtatcgcgccactgaacgcgctgcgggagaggacctctgcgtgcggcaccgcctgggctggcctggcatggctggcatgggcggaggtacacagtgctgtcggcctgcattgtggcagatgatcgcccactcctagcgggcggcggatggcaaacccgcagcatcccctcccttgcccgagacaaaacatcttcacgtcaggaccagaagcgtcttggcctggcccgcccacctgtttccgatcgcacagcaaacgcaatcaatcaatcgtcgtgcaacgcgagccgacgtgcgatgacgcctgggctgccgttacactgcggtggccgcctcccagtggccgccaaggtcggcgctgcatgcggtctgcacgacaggcgtatgattacatatcgagcacccgtccggcacaccttacctccctcccatgccttgccgaccgcatagttaatttctaccggtcgtgcgtagagtggatgaggcagctgccttgcctcatcgggggcctgcttaccaccatccttgtccccagccctcgttcataccctccaccaatccttctcgtaacaattgcctgttcttcgcgctcggccagatacaggaggcaaaattagatggtgggaaaacaagattcaaattccttgcctttctctccgcatgggaagggggagtctgtctgcccgtcgggcccgtccgagggcacagcactattcgttgaagccaaagaacgttccggcgatgacaggacccgccagagctgcgcgtcgtcggccgaaactgccagaatacacatgtgccagggatgatttcgtttccaacgggtggcatggaaattggcatcgccgcccccaaccaccccgctgttggctgtaggttggccgccctgttcattattccctctccttcgagcgcaagtgcggttctcaaactcctcaaaagaacggggagacgctcccgagagtggacggtctgcccctgcgctctatgagacgggcttaggccttacttgagctacaagccccgtccgtatccacagtgttcttcgagacaatgcttggtgttcccggtgtaagcagccatgctgtaattaaacgcttgttacatttacgtagcataggtgggcatccgtggtgagatgctcagtgatccggcgcactcgtccagcatagcttgtccgtccggcctgatcctttatcagttctcggtggactggtgccgctgtgttgggttctcgtctattgcccagcctaccttgcttaggcctggcggcagatttcgtagctgctcggtggagcaggatcccccgcacaggagaagctctcacacatctcgatctcccctggaaatttcaggtgagcgagctcggttcaacatcaaagtgaagcatgaaccatcatgttccagagaatgtcagcgctctcacctgagccaaggctctagctagtgccccccgtttgcagccaggcaggcggcatgaggccgctcgttgatttgtgtcgcgtggtgtggcctcgagaagatccgctactaagtgctggtgttccttgtctgcaactcatgcacatcattcatgcccccaactgttaggccgcacggcacttcatccccctacccaggcgccgttgagcgacgtggtgtttgcttctgggcactgtactgtactgtaggttatatgtgcaaacactcagttccacaccaacacattgagatgataactatagtgacatggctggcttgactctctcgaggaagcttgacctaccgaggcaatgtgttcttgcccgcctcacctttgaagatctaaatgttgccaaggcgaagaattttctgtttatttcccctctttcctctttacccacagggctgccccggtcatgatctacattattgctgactttgatatgaccacagacggcacttggctcgcgatctatgagggagcgttcgcgccagcccacaacaaagcgacgttgtcagtcgagaccggtaccttgtatgttcacgagtcactctacaggattgttctctctccagatgacaaaggaagagcactagcttttgctcgaggtaggcaagtaggtattagctaagccgtacctatgggcactgggctcatcccagtctagttggcttgagaggcgttgggagagccagggactacgtatttgtcagtacgcagttagctcaccagcttggcaagatagatcgatctatgctgggagcatttatacgtctactgcacttggttgaggttcccacaacctgtcaatatgcacataatgtgtatgctgaagattgttttccgctaaaccatgctcccaaaactttcttttttgcttcgatcaacgttcgcgaaggcatatataccttctgcaggagcgttgaaatctagccaaccagagcgggcactactcgaagtagctgttgaagtcctgaaaacagaattggcggggtcaacggctccgtggtcgaggacagccgtgattgtactccacgcctcgagggatggagggcacagtggaagtccagaccaggcagctggtgcatggttgttccaaaacatgtcggcctagtttctatccgtagtctagctcgtagatcaagcagtccgaccaaggtttggtttgggcaagcacaaagccaaacccaaatgccagtgtcgagactcgcgccggaggtgagcacgtgatctggatccggagcatcagatctcccggtgggcggtggccggaagtcgctccatccagcatctcgagcctgtgacaaggagcccgccagcattgattcagtttgatatcgccagatacgtattccttcgccagagtaacattattttttcaggcctgtacggccctgggactcgtgcacgctctccttctcgcctcctgtatgtctcacaccttcaccacagttagcgccgctcgcccctcctgcgtgtcgcaagaatcagattgtccaccaccacaactgatatcgctgcctccatcccccggtcccgcctcatactaacttgtctctggcaggcgatcgctacgtactccgatagaaaatttttgtccatcgtcgtgccggaccagcgccattcctctgtctcggccagcctcctctgccgtttttgacacccagccgatcgatttctccgcctttcgctgcactctggctcctcctctctcttccccatgggccattgaacctcgaaggcgacctcccgattacgcaacaccgtcaccaatgagcctgtaaggatagttgtttgtgcgaagcccttgcgcgagcaccactcaacttatctgctgctctcttgctttgagtcacgtcgagccaccatcgtcgccaccaatcaccacaactgcaaaccacgaccgatcacgaccgaccaccgccgaccctgctgaaatcgtctctagcctcgtccacgtcaatttcgaggcagatgcacaccaacgcctatctacgtaaccacgacagagcatctcctacctccatatacccagttataccgtctggaattttcaaccaccaattgctgccgtcaaactcgggctgccgggcacgcacaactctgccggcatgtactcccaaaatcatcagcagggccataatgcccgcctaaacggcactggtcgcggcgggatgcctcccaatctcctgtacaatttccaacagcacgcgcagcatcaacatccctcccaggcccagcaccatcaaggactacagcccgaccacctggcatcctcgaacgggctcggtcaccactcatcctatccatccggtgtcctggggagctcaacgccgttcaatgccggtcttcagaacggccactcagcttcgagagctggccaagctccgcagaacgagatgtgggcggagcaaattcggttgcacgaggaatctaagcgagctcactctgcaatgaccgatcaacaacaaccgcactattatgcgcgacttaaagcatcggaaaataaaggcattggagcccctccccctccttccaccaaaacccaagccgatggcgaaaacgactcgtccgataggaggaaaccgtggacgtcggccgaggagaacaagaggcaggactggcacaacatggatatgagtggccaggggctgcgaaatctggctacagagctgttcaggtactcgtttctcaatgagctgtacattgcctcgaacaaactcacccgcctaccaaagcagattggtgagctgaggcaactacggcacctggacgcttcatacaaccagattagcgagctgcccgctgagctcggcatgtgcacatacctgaagcagctgctgctcttcaacaacaatatcacagagttgccattcgagcttggatcgttacacatgctggagatgcttggtattgaaggcaaccctctacacaccgatgtcaagcaggagattatggaaaagggaaccaagagcttgatcaatgccctcaaagagggaggacctggtaaggaaacatacaacctgatttgctggtatgaatgaccgtttgctgatctctagctataaagtgccacgttctccccctccccgccaacccatcactattcaagaggacgtgtcccccaacttggaaaggatcaaggtcttctcttggaatattctctgcgacaaatacgccacccctcagacctacggatatacgccgacttccgcgctaaactgggattatcgcaaggattgcgttctagaagagcttcgcgagagggatgccgatttcctcgccctacaagaagtgtccactgaggccttcaaggaggacttcagcccccctctagcccggctcgactacaagggagtccactggcccaaatcacgagccaagaccatgtccgaaaaggacgccctctccgtggacggttgcgctgtcttctacaagcagagcaagtttatcctgctggacaagcaattaatcgagttcgccaccattgctatcaaccgacccgacatgaagaaccagcatgacgtgttcaaccgagtcatgcccaaggacaacattgctgttatttgctttttcgagtccagggtgaccggtgctcggatcatccttgtcaacgttcatctcacatgggacattgccctcgcagatgtcaaggttatccaaactggtatcttgatggagcatgtcaccaagctcgcagaaaaatatgctaggatgccagccgtgaaggataagaagatgatcaccgtaccactggcggacgacggggtgatgcctccacatgtggaacctgggccaagccaggaataccgcaccaataccgagatccccttgcttgtatgcggagacttcaactcgacggaagactcctctgtgtttgatttgatgtccaagggtcgcgtaccgcccgatcacctggagcttggtaattatcaatacggaagcttcactcgtgacggcatagaacaccctttcagcctgcgcgactcctactcgctcaccaaaggcaccgccgacgagctgacgttcacaaactacaccccaagtttcaccggcgtgcttgattacatctggtactcgaccaacacgctcgaagtggtcaacgtgcttgggcctcctgacgctagctacctgtcgaggatccccgccttcccatactggcactacccggctgatcacatccaaatcatgaccgagctcgtcatcaagggcaggaaggacaagaagcagctgccagagcgggaggtagatttcggcagcggccgtgggtgagacgaacgtttgtatcggactaagccagatggatggatacacaagtacttggaaaggcatgtcacatgagaggacatattactctcagctggggaatatggacgggattatgggtgtctctctacctggattgtagggctcttttcttggcttttgtggaacggagtttccggatttcttgctcaggaagggaaagggagtagtggcaaagcgggagggttgctaacggggacggggatatatagtgttagtgccatgtaaacggacggtgataagcgaggtcgtggagcggctttgtttggaattgctggatttttattcattcttcatttcatgcgggggggggatgttgttttcccccacgttcccactcctttacgtgtgtacgtgtgttcatgtgtgatgttacgcgggattcgaacccccttttgtttgcttggctccgatgtatcgcgaggtgccagatgaaaaactgcttgtggtacccaaaatctgacgctcaaacacaaattaatggccgacgcgggtgaacctgagttgatcacctggtgagtttgtgaacggcaccctgtcttatctggtcctacagctcctcctgcgtgtctttgggtgatgccggcgacttgatcaagtggaacttctcctgccgtccatacacccactcgaacttgccgttgacccagtatacgtcctcctccagggggaacttgagggtcgcattgcgctcggggacgtagtgctcggcgagcagctccacgctgtaccatgttctgttgaggagtgggagttctccgaggacggggacctcgtcttggaggtttgtcatgcctgtgatacggtcagaaatcgtgtccataagcgtcagatgactgtagttgtgtcttccagtctggattcaatgaatggtatctgaacagcgtgatggcgacttgccagttgagaggtcatggtgtcaaattctcctccgttggtgttaagacttaagccgtcggactttcatgagattacaggccactggccaaagtcacagtgaaacatccacgatcccaggagcatttcaggggtcgagatttggagatagtagtaggtaacttaccgataacagcacctgcggcgtgtccccagtcaccgatggcatggcagtagatcttcccctcaataccctcttcggccatctgagcccgggttgcctgcaggatctcattgccagtctgccccggaatcatcttctcccgcaccaaatcctggagacggttgcccttcttcaagccctctttcagaccggatggaacatcatcctccgtctccccagggtacagaacatacccaagatgctgcgtatcagtattcatccccagggcagtcacgccaaagtcaacatgcaagaggtccccgtacgcaatcgcccgctgcggaccatccccccaggggaacgcctcctcgatgatggacacgctgggctggaaccaggtcgtgtagttgagctcctgtatcttctcgcgcatccaccactccacgtccgccgtcgtcgtcgtccccggcgtgatcacccgctcgctaaaggcctcgccgatgatggcccacgccgtctcctgcagccggcggtaccacggcagcctcgcctcgatctgcgtgccgatgaactcgaggttgaccagcggcctgacgacgaaccggtccgtccactcggggcccagggcgttggcgatggcgtcgctctcgcccgcgtgcaggcccgaggcgaacgccagctccgggtgggcgttcacggcgatctggcgcggctggtggcggcgcagcgcgtcggcgagctcatcccagacaccaggagtattgtcgatccaggtgtaggacgtctgggccgccgcctcgtcggcgacgaagagggtggtggtgcggcggcgggcgctgaactgcgtggccgccttgaggggccagaagacgacgtcctcggcgtactcgcgctggctgatgagccaggcgtcgacgccgtgggagcggaggatgcgcgggatcgaggccctgcgctcagccgtccaggcgtcctggagggcggcctggtctcgcagcggtgggagctgctggtaggtggccgtcgtcgtcgccagggctccgtggatggcgagggcagccaattggagtgatgggagcttcatgatgggttttcgcgaagcaggatttacgtatcaatcaaatcatgggtctcatatgtgaatgagggttggtggatggaaaagggcgggtgctggagggttgtcacggaggatggcgagatgcctgattgaggaaactccacagagcagcaaatgatattgaccgttctggcggatcatcgcctgaacatgacatgggtctagagtaacaagattcgggtaatcgggctgctgtgattgcaaccattgatctcggatggatgtgtgtaatcacgcaattgctatgtccaggttctcaggaacaggtaggagccaattctctcgagtttcaaaactattacatatttctaagctctgagctcttccttgaatatacaattgtacagacgatatctgctcctctgattcgtcatacatacaggggtcctgatagttggttgatggaaagatcggagcctatctcatagaacaacattaagagccttcttactaggtttaattatactgtagtagcttcgtggactttcttaaagatttgtcttacatgttctttctcccaaggctgactttctatggctcactctaccttaacacgcaaatgtgtccttaagatagataagaagatatcattttcttcctgccctaaggcaagggtttccaaagaaaccgaactacgagattcgttcatcgtaaagtccccatagctttgttcaaacaaaggttggtgctgagcttctctatctatgccaaggcccgcttatcaaactcaagctctcatctcctggaatttcaggtgattctgtcatcggcaagaactaaaattatatctcgagatatctctctcgaccaaaatcaacatcacaggtgtgcagaacggtgcgaaatcccaggatactttcaccagctttgctgtgccatgaagcctggtatgtgtccaagctgatccggagattcatgcaactcaagcttggattatcattagtattcttcgtaaaaaatatgaatcatgtcgccacgattcatcgtcgtctatacatgtctcgtaaagcttcccaaagtcaatccagagcaagtagaatttaggtgtggcggagaaaacatgcagagcatattgcagctcggaagcttaaagaagcgattttcagtcttctgccataattgcctaccaggatgaatgtcgtgtcacactggaatttcctcccatttgtctcaataatgcagccagggcttcatttatacactttccgcccgatggcccaagccagcgtttgtcacatttctgcccatcagctgctcttgccgactcgacctctgccaggccggagtgctattggcgacacataaatgcccattttcagagcgatatgggaccgaccaagttccttctttgagaatcagcaattatattactgcagtgacactccgggtctatcgtatccttccccagccttgcctcctccaagtgagcagatgactgatctgcagcactaggcctaccttgtcctgatgctcgtggggcgacctcgcgtggtctaagccggcctcgacgcaggctgcccgtggaataactagagtaggggacatatatctggcgaactgcatcctacggacgattccggcagctatagcaaattgtagcccaaggtttcgtgtccctgaaactgttcgctcagccttaagacgcaagtttcgagcttaagccggggcttaggctgcgtgtggttttgctatttctgaccaaagggtcgtatccaagctgagcttggcggagctttgcccgaccgccgccacttgctgcctttctttcagcctacccgacaccgacaccgaccaggcctcaacttcgactcgacaacctcgatcaaagaccacggctgcaaaccgtctacgacccccctccgagccgattcttgcttccacatcaccgctgccatggcgtccagccgagaccgtcgtatagccaaggagctggccgacatcacctcggaccaggccaactcaggcgtcttcgctgctcccgccgacggcgtctccctcaagaggctcgtgggcacaatcaacggccctcccgacactccatacgccggcggcaccttcgaggtcgacatcaccatccccgacgcctaccccttcaagtcgccgtccatgagcttcaggaccaaaatctggcaccccaatgtcagcagtcagacggtaagttggaagcacaataaaacaatcaaccccaccaaacccctcctacctcgaaaccctttgccccctcccttcagaagccagttcggccaagaaactgacgagccctctctcttcccccccctcgcagggtgcaatctgcctcgacaccctcggctcgggctggtcccccgtccagaccatcaagaccgccctcctctccatccgcatgctcctcgagttcccgaaccccaaggacccccaggacgccgaggtcgccaagatgctgctcgacgaccccgagcggttcgccctcatggcgcacgagtgggccgtcaagtacgccggcgcacagaggagggatctgaacctgagccagtacaagaacgagggcaggccgtcctcgcacgacgatgacgtgaggaggtaaaaatgcccctccccctccctctcccctcccccctccaaaaccaacccgctctcttccccctctcaacacaagcagagaaattgacaacaggttttttgttcttaggtacaacggctacaataaggagctggtcggccgcttcgtcagcatgggcttcgacgtcgacgccgtcgtggaagccttcctctacgtcggcgttgaccgcaaccacggccaggactacgagctggaggagcggtacatgggcgacgtcaccgcccgtctcctgggggagtgaacgtggctttgcgagaaaaagaaaaataccccctcctctttatatatatatgctcttgcttttggttttcgggtggatgaaacgagctgcaacgtgaaatttgccgtcaatttggtctccctggattttaggcccggatgtgccgccttggaacgtttactaccagcatggatggggagtttatatggttgtttatattgtcatttgcgctagattctataatagtggtttccacgcagcctgccgatcaattgatttagtttagggtcatcgtgctgtcccagaggctcagagtcatcgttttttctcgagggagttgcaagtgcgggctcactagtccagcgattgttcaagatgttgcattattttttcggagggccgtgaacattcgatcttccccgccgccggcgacgtatattagccttctctacatgtcatcaaaaaatttgaaggacggagggtcaactgataggtaggacccatccagcccagataaagctcagtaaccgttatgccatttattcacatccagacatatgaaagggaaaagtgaacttgagaaacaagggtcaaaacaatatcgcactcccgcggttcaaccagcccggcccgttctatcagatgcgtacggtaatggaataaattaaaagaaccaacccgctatggtcgcggcggcctgtcctcctccccttcacacacactcctctctcccccatctcatagcaagagagatgggggccgacagacgaaagagtgcagtagattacagcaggtcgcggcggacgaactcgtcgtagagggccttgcccagaccagctggggagcgctcgacgatgacgccggcgtcctccagagccttgatcttggtgtcggcaccacccttgccgccagagacgatggcaccggcgtgacccatgcggcggccgggaggagcagagataccggcgatgaagctgacgacgggcttgccgccgttgacggtgttggcctccttgaggaactcggcggcgtcctcctcggcggaaccaccaatctcaccaatcatgatgataccgtcggtctcggggtcctcggtgaagaccttgaggcagtcgatgaagttggtgccgctgaaggggtcaccgccgataccgacgacgagggactggccgagaccagcctgggtggtctggttgacggcctcgtaggtgagggtgccggaacgagagacgataccgatgcggccgcgcttgtggatgaagccaggcatgataccgatcttgcactggccaggggcgataataccggggcagttggggccgaccaggcgggtcttgttctgggtcttcagcatgctggtgatgcggaccatgtctgaaaaggatcgtgttaggagtcgagcatcgtaaggtgggtggttcgacctgtggggaacataccatgctgagggataccttcggtgatgcagaccgccaggggaatctcagcctggagagcttcctcgataccggcagcagccagaggaggactttgcaaaattgttagctggttcaaaagtcggagagggcggcggaggcaatagcgtacgggacgaagagggcggtggcggtagcaccggtctccttcacagcttcgctaacattcttgaagacgggcaggtcgagatgagtctggccggcctttttggggttggttccaccgacgacctgagttcctaaggggttgagttagcatccacaggcgaatgaggtggctaattgaggtttcgcaatcgtgtggcggttgctgctcgtaccgtagtcgatggcttgctgggcgtggaagctagaggaggcccctttgttagtaagacgttgaccgaaggggggtaaagtgtcaagagcttgaacttcaagctaaaggtccaacaaagggtcgcaccactcacgttccctgcctgccagtgaaaccttggtagatgaccttggtatcactgttgatacgcaggttgttgattgtctgggcgtaaggcaagctgctggagctgtatgcgcgactggcaacctggcgcaaagcggccggtcgtagagtcgatctggggagggactgcattgtgaaagggggttaaggggaagaaagaagaaaatccaggtggaatggccgcaaagtcaattgcggacggggcgatttgatgttctggaaaccttgctcggggagtcgaaagtcacaagcctaggtgatgcgaggaagcatcatatctggaaccagtatgcaggccatatgaacatttccattttcagtcgggtgtgttcggaccctcggtgtgattttttccgaaattgtcggttacgttgcgccgttgccgagtaaaaagccctggagctgtgcagagacggttagtgacggccatttacagtggtccggtagggttcagacgcagggccagtgtcacgccgtaacagacggcgatcgctgatcaaatacggtggtgagcgttttagacggggtttgctgacctttagccccaccaaagttttttgaagtcagtcatggcgaggggcagcttgtgaatatctagcgttgtggcggaggccttgacttgacttgacgaaccctggtggcacgtcttgtttgtgacgatacgaacgaggacagaatttcaacatggcgaccaccaccgtgactgcgaccacgtccaagaagaaggccgccgacctggtgcctgagaccgagcggtacctgcgctgctgtgctggtatcgcaaacgccctgatcgaggaccatgaggcgaccaaagatggccgtgccgggcgcgacatcaatctgaactcgctgagggccaagctctcaaagaagcacaaattgaagaacatccctcctctcacggccatcattgcggcgattcccgagcactacaagaagtacattatgccaaagttgatcgcaaagccaatccgtatgtcattccccattggaggtttgagatagactccgagtcgctaacaccgcaaaggaacctcatctgggattgcggtcgtggcagtcatgtgcaagcctcatagatgtcctcacattgcttacacgggcaatatctgtgtctactgccccggtggtccagactccgatttcgagtacagcacccagtcctataccggatacgagccaacgtcaatgcgagcgatccgagcacgatatgatcctttcgagcaagcgagaggccgagttgaccaactcaagtcgctgggccattcagtagacaaggtcgaatacattatcatgggaggcacattcatgtccctacccacgtcataccgcgaggacttcatctcgcaactgcacaatgctctcagtggctaccagacctcgaatgtcgatgaagcagtggaggctggagaaatgagcaacatgaagtgcgtgggaatcacgatcgaaactcgccctgactactgcctgcagccccacctcacggatatgctgcgctatggatgcactcgtttggaagtcggcgtgcagtctctctacgaagatgtggcaagagacacgaatcgaggccacacagtagcagctgtggcagagactttctgcctggccaaggacgctggcttcaaggtggtgagtcacatgatgccggatcttcccaacgtgggaatggagcgcgatctggaccagttcagagaatacttcgaaagccctgccttcagaacagatggcttgaagatctaccctactcttgtcattcgcggcactggcctatacgagttgtggcgaactggacgctaccagaactacacgcccaatggcctcattgatctcgtcgccagaatcatggctctcatccccccctggactcgtatctaccgtgttcagcgagatattcctatgcctctggtttcatctggtgtagagaatggcaatctcagagagctggcactggccagaatgaaggactttggaaccacttgccgagacgtgcgcactcgagaagtcggcgtgaacgaggtgaagaataagattcgccccaaccagattgagttggtccgaagagactacactgccaacggcgggtgggagaccttcctcgcatacgaggatcccaagcaggacattttggtcgcgctcctgcgactgcgcaagtgcacagagaaatacacataccgagaggagctcacgggccagccaactagtatggtgcgtgagcttcacgtctacggtacagctgttccagtgcacgccagagaccctcgaaagttccagcaccaaggtttcggtacgctgcttatggaagaggcagagagaatcgccagagaggagcatggcagtgagaagctcagcgttatctctggcgttggtgttcgaagctactacaagaagcttgggttctggctggacggaccgtacatgagcaagtgggttgatggtagggagcagcccaaggagtaaggggacatccaattacaaaaaacatatcatgagttaccgatcatataagggacatttccgataggtcttcgaggttgatttacaggggcgttgggtggtattggttcttttaggcataccttaggcaaaacacactgaattgatgttacttcaatggttccaacgcgagccgccttccagaaacaaataacgacccacctccgtcttaaattgagaaaacggcagcacgggctcagagaagcctcgcctcgggagtgaaagttcatctgccgttagcgcccgtatattctgtcggtggagtcaggactgatgcccgtcgctgccttacgtaacctgcctcggcttctagcggtttgcccaagcggcctcgatttccaggcatatgaatggccgagcctgctgagtcagcacttcgccaatctgcagcatctcgggatattatcatcgttcctagtcgacccgattggactcggcagcattcacttccacggagccagggggccaacacaatgtaccggcagagccatgtcaactggtcgtaaggacgcctccgctgcggccgtcctgcctccggggactgacccagcggctcacctctcagaccgtcccccgcggagcaacgccgccacagctgcttctgctgcctctgtccgagccttgagcgcccagctcgtagccttctacttccgtgcgccggccaaggccttcttccgcacgcgggtggactatcttgcctatgcccggactgtccatcaagcccatatcgaggggctgaggaagaccatcaccagggatgcgaacgcctcgcggctgcaggtcttcctgaaggaggcgtggctgttacttcgcgggacgacgcctggggtgttgaccaccgccattagacaccagggatggagtgtcattccgcagcagattctcccaccgcttattgcaaatgtgggcgttggtgcggttctctacaccagctaccttcagattcttggccagctccacgaggagagcgcccaagcgcgcaagagggtgtatccgcctcctgatccttctcacactttcacggcgggtttgctagctggcagtatccagagcgttattgcagcgcccctggatgcgttacaagcccgtttcgatcatcgggatatgatgccaaatgacgggagcaacaggcctcgtagcatgtggagtttcggctccgagaaactcagagagatcggtttgcgtggtatatttgccggatgggggctttccctagccaaagatggtctgggaagtgccatcttcttcagcacgttcgagtatgtcaaggcccagggatactaccgcttcgtgacctggtactacggcggtctcgcggaggatactgtggatctcttagccagcaagcgtccgacccattcgcgtgagaacgagacgacaaccatcatccgaccgcattatgctctggagcctacgttcctacttctcgcaggcacatgcgcatcgctgtcacagcaggttctcctccatccgctcacacatttccaagtcaaacactgggaccacctcgaggatctcgatgccaaggcggcgcgtttccgggcctcgcgagctgcgaacccggacaagccatggcgtcgatggcggatgctccgcgcgtactaccacgcctaccaagaaacgtgggctgtctgcggcgccgaagccaagaccgagggcctgggtatcgtgaagtggctgtaccgcgggttctggtggaacgcgatccgacaagtccccagcaccagtgccgggctgatcatctttgagctcattaggcgaaagtacggattcggctccgaagaggtgaggatcaccaaggacggatacgacattttactgcattagaatcacatattttggatacacttctatatataggaaggtgtggcgaaggcgtctggagattaggtagggatagatacttttgcttttttttttgcggcaacgttatgaggaacaagacatcgccactttgggtcggattagaatgactttgtatttttggcctgttagatagatggacacaggcatcaatagcctctctggaaagatacatatacgcatctcatacatttcttgtcccagtccaggatatagagtcgtgctcaaatagaggatggaggtgatgttgctagtagcctctccccctctcttacgattcctcattctaggccaaggttagtgttgtgcgatatatagcttgtcccagatacaagtattaattctgttgaaaccacaatatattggaacagtctcggtaagtctatgaatacgaggccaaggaacaactatctgctgacaaaagaaatagagagaaaatcaaagacgctgtaagacactcagttactccaaacaacgcccaagtcaaactagctcaaaaatacccgtgactcaatcactgcccagccttctcgtcagccttggcgagtctctccttctcgtcagcaatagacgaagcatacagctcctcatccttatcagagtacgcggggacctgctccgtctcctcagtgtcagtaaccttgacctcaggcatgacggcctgcttctcgtccatgacaggcatatcccgagcgggagggggaacggcggccccctcctccacaacgctgggagcgtaccccctcccatcctccagggccttgagcacctcgaagagaggtcgggaccccatgggccacgccacgtcgccctgcaggatcctctgcgccgtgatcccccgctcatcgtaaaatacggcattggcatccgcccggctcacaatgacagtgccgtcaacctgcacgcccgcccagataccccggctcttgatgtagctccacgccggccggccggggttcgtcaccgcggcgttgatggcactaccactacccacggggccgagcgagacgccaaagttgccgcccagcgccacctggggcttcgtaaaggcggcgacctgggcgggcgtgttgaggacgcacacgcagtcgtagacgtcgaggccgaacatgaagccggcgccgatagtggtgacgaggaaggccgaggggggcgaccaggtgccgtctggtctgcgggcagtcacgaggcccgagccgccggcgagggagccgtgccaggcgcccacgcgggcggtgttgaagatggcgaggccggcggcgttgtggaggaccttgggggggatcttgaccatggacttgcgggtcaggccggtcgggtgcttggggccgttggaatttggtggttgggaggagctgtcgaggtctggaagattgggcgtgttagtcaaagtgatcatatggctttgttttcaaggttttccgggggaactaaggacatacttgtaaaggagtggaggattcgggcggccttgacacactcgtcctcgacggacgtgggccaccagccctcggagccgatgatgttggtgagtttgttgacgggcttcccagttgcgatggtgatcttgtgcagacgctcccggagagttcgtcgctttgcgatgtccttctctgggatgggctggggctcttgagctgggtacatggcgggatcgtcggagtaggcaggaggttgtctctcttgagtctgtgatggctgctcttcaggatagactggggtgtcctctcggttgttcgacccggccttgtcggaggtgggcttgtcggtgtagtaggcggtggcagtcatggtggtgaatgtgttagtttaaggtgtgtgtagtattagggtagagaggtgagtgtatgagtaaaagagcatgaaagctgtttgatatgaagaaggaggagtctagatgacgagtctacaaagtggttatatagatatatcatcccggcggaagaggcgcattgatgaggcactgcactacactagctaacccatccatgggaagatgggcacctggatagatctcgcctcgcattcggataatcctgctcttcacatgccgcgctgttgacgcaagcattatgcctctgccgcgtgcgcatttgccccaaccggaggcgactcgcgcggtgtggacgagaatctgtcgcggcagagtggcgcagctcagcaccacaccacgaaccaggtaacgacatgttaacattgaaaacaaagcgagccctgtggggaaagggacaacttcctgccgaagactggccagctcattattaatcccgctacctagaccctggatgtttgtaggtaggcatgccttcatagccttcgcagccctgtggatggatgagatacgctgtggatgatgccccagacgcacgataaaaatacccctgggtttcctgattgggcaatgaatgcgccaggggcattggcctgtcccgaattgcgtaagaatcgacttgcatcgccggctgtagatcccggctcgatgcagccctgccacaccgagcccgaggcgagagagcagcgaacctacagcgagatgagatgcaaccttggagacgcactgggagatttgtctcttttctggcgtttcagaactgaatccataaagggcttcttggcatgttttaaaaatgactgcattgagtgtaaactcttgacctagcgtgttcatcgttgacactacaaccatccctaccaaatatctaagctcctcaagcgtctcctgtagatccagatgaacaaaccaactccaatcagtaattgctcacgcctaatccgtttgttttaaattcgacacttagatgaaatagaacgaaaggaacatatccatcaccaggaattatccaacctgttgaacgccagatctgccgctacagggtagcgtggggcactcatacagcctgcgtcatcacttgcctgtacaagcttccaaatgctcccagagctcccacctcacaccatcattgacgagacatcacaatacgcgctgctgccgtaaagcctccccgtcttcttcgtacctgtactagaaacagccgcgatccattccatcttcaattcgaggcctaccacttgacttttcgctttcaatccccagtgatttcttttgatactcggtcgcgtcgcaaccactactcgcccaagcttcccccaactatccagcttccagataccctcccttgacctgccacatctccccaaaccaaccgcagcaatgtccgagtccaacggcatccgcggcaccgtcaccgacaccgccgccggagcctactcatacgcccagcgctctctcgaccgtgtcgtcccaccggcctcccgccagcaagcctacgaccaagtacagacatttgctcacacccgtcccatcctcttcgtacgcgcccccaatctcctcatgatacttgccctcccgtcgtaaattaaagagagtgaacccgcttgctaataaccaacccgcgcgatggatagtccgccctcgtcgcacaagtagtcttctgctccacgcccatcctcatcttctccgccttcgtcttctcgacactcgtcttcgccttcggcgtcgccctcctcttctccctcttctggttcggcctcgccctcttcgtcctcgtccccgcgctcctcggcgccgcctccatcgccgtcctcgtctgggcctgggcgctcggctccttcctcgccgccaggtggctgtacgtccagctcgtgggcggcgaggccaccaaggccgttcgtgtcaagtccgtcgatggcgccggtgcccctccgagcaaagaattctagcgtatagccggagaggaggcagaggagttggggtatgattctttctacgaaacttgtgttgtaatatcgttacttgggagccaacgtcgacttgtatcgttgacagattggcatgtgtttttttaatatttttctacgactgtatgattcaaattggacgcggtgggacacaggctgccacggcgtggccttgccattgaaactggaagttatattatcatggctttggggacctaggttggaatggctaatggccagctctatcaggactgaatggccactggcactttactcacttctcccacgcccatcctacaacgattgaggcaaagggtggtgaaatattgattcgtttattcgcttcccatgaacaattcgactcgtaacgcatctgaaaccgctgcccaagaagccatgattatatttatcttcccgtctaacctgtataataagtccactacagatacaagccttcgggctcgccctcctgcttcgtgcgcagaacacgctcgcgcgccgatcggaaatcggccatctggacacgcattcttcgctcccgcagagccaacataccggcttcagagcaaatggccttgatatccgcaccggatagatcgtccttttgcgagatgaactcctccagctccacatcgtcactgagattcatcttggatgtgtgcaacgtgaaaatcttgcgcttcgtgttctggtcgggattttcaaacagaatctttcggtcgatacgtccgggtcggatcagtgcagggtccagagtctcgatcttgttggttgccatgatgaccttgacgtcaccgcggtcgtcgaaaccgtcgagctggttgagcagttcaagcatggttcgctggacttcacgctcaccacctgacgtcgaatcgtatcgcttcgtgccgatagcatcgatttcatcgatgaaaacaatagatggggcgttttcgccagcgacctggatttaaagttagcgaggagctcgtagcatagagattaagagcatagcatacctggaatagctgtcgtaccagccgtggaccgtcaccaaggtacttctgaatgagctcactacccacaatacgcaagaatgtggcagatgtttggttggccacggccttggcaagcagcgtctttccggtacctggcgcaccgtacaggataacacccttgggaggcttgattcccatttcttcgtaaagttctgggtgaagcagcggcagctccacggattctctgacttcttgaatttgtgtttccagacctccaatatcggcatatgactctgttggagctttgtcaagcttcatcacgctcacaatcggatcagtgtcatcagtcagaacaccgacaatgctgattatcttatgatgaagcaagacactggcaccgggttcaaggagatctttgtccacgaagctcatgatgctgacgtagtactccgggccggtggtgctgctaacgatagcgtgatcgtcgtcaatcaactcctccagtgttccaactcccatcgggctgccacgcatatcgtcgactcggccacgctcgtctgctaggcggtcgttatccgcatcggctcccgaagtctgaccctccttagccgccttggccttgcgaaggcgctcctggttctcaacgtactcctcttcaagcaggaggtggtcatgaattcgctgcatgcggagtagacggagcttgcatctgctgctggggtatacggcagggagcttggcggcagcgctggtgccgccggccttcttcttcttgcggccgactcgggtcgtaggtcgtggcggtggttcgtactttggcttatccttctgttggttgggtcagcatcgaattccatgcatcgacatcgagaagagtcttggcggagacgaaccttcttatccttgtcatcccgaccatcctggcctcccatgccagactgtccctgaccctatgattcgtaatgtcagtacttgaagcctggcaatcaacaagatagtggataaccaaccatcttggcgagtaaagctccaaaagcttggagttttattcggaagtcgtcagttaggcacaatgcaatctaatagagtctgggtggtgtgcccaggcgagcagactgcaaagtgatgttgatgttgagtcgaagctggagtgggtagctggatagcaggcaggccagtgctccgtcgacgatgatggaatcaggcgccagggcgacacgacgaccagccttcacatcacgtgaccatgcttagtcacgcccacctcaacctcaacaccactcgaaattcattctttgattagaagcttaacgcagctcttcataccagacatcagactaccccgataggcggactgtgaactggaacgtctgaatgaaggcctgttcataagcgttgaactagtgcaaatagcacaaaacacacccactagaacagcttcgaaaagagctatgactacataagggaagccaacaggcaggcaataacgaaataaagaaattcataacttcttttgttagtctttcgcactcggatccaactactatcaatttagggctatggctgagattactggtcttggagtggccttcgacagtgaccagtgtgaggctgtgatcatgctctaatctttatgtgtggaatggagtttctgcgcatatcttaacgtctcgtaacaacattttcataagcatgccctagtaatcaatcaaaacaagcatttcacctctaatatctcaaatcaacaacaatcaccgacgcaagtggctggttcgcttcgagagacttggggccatttagacaggagttggcatcctaaacttaccgtgtgagaatttcataacgttcaactgagacgtacaacaataagaagcaacaatcaccttcaagttcgctcaaactggctacttaggaccaaaattcgattgcgggaacatgatattcttggatcctcgtggttattaacagataatgagaaaggcttataacgaggacaagagcatgttgctgccgttcgagctggtatggctgttattgagcctgcctgtccacaagttaccagcatcgccaaaaacccccagtgaggccaaatctcacagctcctcgtcggctagatctaccagatgtgaatcaaagcaagcaaatacatgaataatagggagaggatcacgagctccattacagagggggcagtattgctacgactcgataaacttcacagaagaaatgagtgtaccgcacgtgtacctattaagagagaaaatcacgagctgagagggtagaggataatgataactttttggctacatgcacaggacttcgctaatagatacaaagaatatctgaaaataagtagagcaaccaatgtgccattaaaacatgctaattcgttctactggcatttaccacgcaacaccgcgaaaactgaacgtgaccaacacagtctggtatccagcataaagtcaaactgacaatgaagacgataaatacattccaagagtctcaacaaaatatgatgcgtttacagagcaatcatggcagcgccagcgccgagggcaacgacgctgtacagggcaacggcgaggttgccgaagatggagacgcgggagatggaagtgctggaaccggcactgccgctgtcgccagtagtggaagtgctggtggggttggcaagagcaccagtagcggtggcaacctggttgttgtgggcactggcggaggaaatggcagcgttgcaagaagactcagcgctggccttcttgacggaagccttgcccttgtggtcgcaagcggaagaagagctcttctggtccttgtagtaagcaccgagcaggtaggtcagcttggccttggcatcgcacatgctgtaagcaccgtagacaccggtggtggcgttgccgttgataccagcgcaaagctcgggcttctcaccgcagatgtaaccgaagaggctgccgtaatccttaatgtcgaggtcatcggcagggccacactcagaggcagcttcggcacagtcgcaaagagtctggtcaggggtaggagggaggttcttgttggacttccagacatcaccaacggcagggcactgatcacggccggtgttggggttgtagtccttctcctggacacgggtggggttgaccttggcgtgggccttcttgagagcatcgaaatcaccctgcttctcagccttgccgttcttgatctcaacaacaccatagtcgttctcctcctgctggtacttgaaaacgagaccaccagaaaagacaccggtcatttcgtcagagaagagagcctcagtatcggtatagatacgggtcttagcaccaccggcgttgcaaccgtactcagcgaagaagacaggaacgttgtagctcttgaagaactcaacccacttgtcgtaaccagactccttcatgctgctcttaccgcaccaagagtaaatgttgtaaccccagaaatcagtagcctcggcatcctcaccacagttgaagtactcggcgatttcattgcggatatcggggtggtcattggaggcatacccaacacccatggggcggtacttcttgtcaacaatgtacttcttggtatcacggatggcggccttgacgtaggcggaagcttcggtgttgttcttggcgtcagagacttcgttaccagcaaagaaaccaatagtgttcttgtacttggcaagggcgtcgatgacatccttgtaacgagtaaagagctcggtgttccactcaggctcgtcacggttgatggcgagggcaggctgagaaagatcagaaatgacgtagatgccggcgtcatccaggagcttcatgcacttgtcgtggtcgaccttagggtcgatggcgtaagttcgaatggtgttgacaccgagctcttgcagcaggggaacatcgcgcttgcagtcgctctcgctggacagagggtccttgtagtcagtgttgttgccagtgttggtgctgctgccagcagtggcgatctctgcctggtaagcaatacccttcatgtagaactgggtaccgttctcgtagaagaacttcatgccctatatgcccagtcctggttagatgcgcctctttttctggttggaatggggccattgtgcggggatagattatctaccttgatgtggatgggagggagctcggcaacagctgcacccgcaagggccagcatggaaagggtcttggaaaccattgtgaactgatttttagattttctttgatgctgaagcaagttgaaagtcgttaatgcgttgtgactcgggtgatggaacgacacggtcgtggaattagatgtttgcaagttattgttgagtgagtgtgtgaaaagtaagccaatgagggaggaggccaatctcgactaccttaagccaggtatgggcaagtgattcaattagtcggagcgagtgactgaaagaagagaggatgagaagaagaagagatcaaagagatcaaatcgaaatcgagtggtcgtagtctctaaaagacaggataaagggcaggagcagacggccagcaggaaggccgggcctgccagcaataaattgccattccggcggcacccccctgatggtacgctgacaggggacaggccgggccagggctaggcggcgaggcgcagcaccttgctccaaccttacgcttagcggtaggtgggcagctccaatggcgagcccccttgccctatcagtggcctgtgcctggcagcccccagcgggccaactgactgcggagctgcactagggaggcccccaccagttaaaatccacggctcgtacagaccttattgacctgcccgggtctgtgcgtctggttgatattacagtatgagctcctgcgagctcacaagacgagactgacacgagcccgccagccagctcgccccccagccgctattgcccttcgcgccgcccagatcgcctggccatctgctaggcctcgatagtgcagcctcgcagtgcagcgccggcctgcgcactgtagctcccatctcgacaccaccgtccggcaagtatcagcccgtgcctttctgttccattgtcttggccaagcggcaggaataggggcgcttctccaccgcaccatctcccttgaaacataccatcctgttaagcatagtaatggatcagcatcaggttgctgttctctccccaggccgagccgctaggcgcctgtctctgtcctgaatcaagctcatgcccagagtttgctaacaagccaagctcaacaccaacctctcctgggcactggctgatcttggagtcgtcgtcaccacccagccatcgaagcgcgttgcactattgctcttggctttccagcgcattattttatcctttggcgctacgctccaggtctcgtcgtcttggcttcaacgccgtctctccactcctggaccacagtaaatctcgccccctgccactcgtaattccagctctgcttcatcgacgctctagttggcttcgtccttatcctctgatcggcaggcttggtcgaggaggtctccaaacagtcctctttccacgagtgttccatactatgtacgcctagggaggcagccagcaagcatcttccctccccatgccaaggtatcgacctgtgcgacgtactgtgtcaatggatgcaatcgcccgcggtcggctaatagggagtgggtagcccaaacggaaggttatttgtgttaatttcgagggcagatcgcatgaccgcatcgctatttcagtagcagcacggaagcagcagatctagacactcagtgcagatttcgtcaatgcccacaccatgcaccgaccgtcgcgccacagttggacgtgcgtttctggtttgccaaaaggaggctcttggcaggcagcaattctgtgtcaggagtggccattttcgtatccgtgcaagtctgggcattgtgggttagccggcgcctccgcaataataatgcaccacacctggtaacaagactcttggcttcttactcaggccaaactcgtggcgaatgatctgtctctgacccagagagacgattgtcgcatacatgacttattggccgttgttttccattgcgcttccattcacctacgacgccgcggacctgtgtttttcattattgcccagggtgtccgactattaagtgcggtgtttaataagcttaatccgtagggcagccgtcacgtaaaaaagcatgtttattaagcctaatattaatacgagcctagggtgctctggatgtgggagaccgccatccggtccccattgaggcctccactccgtggactccgcgcgcgcctcaccaccaagaaccagtttcttgagatgtttcgcgcccgctcgacagcacatacaggcgccagcagttgagttccagccaattccgaccaattggcacccagcgctgggacagctttgggcgatcgctgcgtgcacagccatcctctgttcggtgtttctgttatcgtagtgcagtgcccgccagccaatagggtactcgtaggtacatggaggtacactgagaggtgttctcactttggcatgtactagaaagatattcgtttacatgtccgaaaattatttaggctccagtaaacagaacaaaaattcattggacattttgaataatgattcaagcctaccatcctatctttatgccgaaatgaatctgttggctcatgaatctcggtgtcgcttttggtagaggtgggcatcgaacctctgctcccacacctcgggacacgaggaacgctgagtggattacttactcagagtgacaaagaggatcactatcaaaggtatgtattactgaagcgtcgtcatccataccagcattacgagattgtctcgtttgaagtaaatacgaccagaatttgacggagtttcacgcatacacatgcgaaaccccaatatttccagctatagggtatctacatcacaagcaccacgaggcacgctcaggaggaggaccagcccccatttcctggccactgcgtctcctgcactggtacgaagtgtcttcttcactgcccagtgccgtgccacgctgtctcccgctatcattcgccaaagaaagttactccccgatcttggctgacgatcgatgtacgtgttctctcttggcttatctgtgggccggtgtgccctctcccgcgacagctccgaagccgagcttgcagataggcctcgcccctcccgagcgtcttcccaaaccgaccaaaatagcctgctccatggctgtgagtcttggaaaaattcctcgtcaaattttgtagggtcagccatcgattccctgagaaaagtcatgtacaccttgagcagcctcagtacatcgtttgctcggcagtcaggtaagtttccgctcagtgtccaaaggttcgacgaatgatagggatggtctcgttcacgaacgttgccgagatctcccagaagccactctgttgctgaaccagcctccaactttggcgtgtctagcaccggctgcgaggaacccaggaatatattgtccaacttcacatcatcatggcagagcccagaatccagatgcatcccgcccaagatctccaaaagacgctcaattgagggtcggaacatgatatcgagatcgcgtgctgtatatgagttgccggacctcctcaactgatgcgccagcttcccaaggttacccagcggtaggaatggagttacaaggtgccattccccggcttcaaaccccgtgccaggcgagaggtaatagtcaacgacggatagaaagcctgctctgttttggcttctctgttcactggccggtcctccaagaataagggaggctgggatttccgttggccaccgtagccgtggttccgtcccaggcatgcagtttctgagcggtgctctctcgctgctgaacactttgatgacatttccctggtacttgaatactctaccctcgaaccctctccctagctgctcccattcatctcgatgtgccaaggcatcttctcgagagtatcgctctcccatttcatttggtggtggaccaccatcctgttcccacggatggttcttgagagacatttctatcatagttgagaaacggccaaatttcgtaggtgtgtacttgatcgcaagctccgcacgatgcctctggaagttatctaggaagtgaaacgctgcaagtatgattgccacgcatatgattgctttccagaacctgctcactcttggactgtttcgtaccagccccggtcgctgccatcgccattgcggcaggagtgaagtaggtccagccttgagatttattctcatgatctttgtgttaactccccccttcgcaagtagagggcgagaaaagagtgtgcatggcttgtggcctgatgtagatattccatgattttatcatactcgggcgtcaacgccggccagttgtcgctatctcccagatgccgaacgcggtgagcagaaccctgattctctgaagaaaacatgccttgttgcgcaattctcggtactgaaggtcttggcgaatcggcgcctgacacccatgtttcccatgtgacgacccgaagaatcctgaccagagccatgagcctgtgacattgtttgacataacttagaactacccgcggattccgtccgtggcccgattccttcccccttgttcttaatttacaatatgatgtgccattcattgaggtgcatacgaccgcacaattgggatcaagactaataattagacatgctaaatttattatggattcggcctggcttggcaagttgttgactctcccagtggtacgtacgcacgcaaggccaagacaactggcgatcaccgaaaaggaacaccatcgagcatgacgtggcatgcagacccagtatacacgagacaaatcgttgccatgcggtttgcatgctccaatgcaaggcaatccaagcgacaacataagacattcgtaaaaaggctcttgtctgagaactgcagaaaaccctgtacttttagcctggtccggagccacacaagtgggtgacataagggatgagacaccaaattcttacgccttctttttggctatgtactaagtaaaaagaatacagaaaggctttaaaaatatatactacctctttctttagcctttgaagtatatcatagtctctttcttgaattatcagggtaatttagggccaagttataacggataaaatataaaatatcgagtcttgctggtgatggatgcttgaagtactggtttggtgtctcatcccttctgtcacccacttgccacagtagaaatatgtccgaggatgccgtagactggctgtttcgatactacagtagttcctcgcccatgttttttcccaacgtgcgtgccaagtaagtgggcgacaggagaaatgagacacccaatggaagagttggttattaatcgactactttctgtaataaatagagaatttcagtagtataaaaatagaagaacgtaactataaatacagtattatgtattattgggactcaacaatctgataataccggtcgcagacttgagaataagcagcttaatgtttgagtgtctcaatttccatgttacccacttaccaagtaaaggaaagcaaactgctcgataggtataaatgggcaatttttgtgtacggcatgaacaatctgacactaaaggtcgtcgatgtcatttgtcttaccgatgccggtagaggtccgtgactagagaaattcgatgggatagccaccggccggctccaagtttcctagtctggatgtatatctgtgccaaattgatatcatttcaatgtatgggggaaatagtacggagtcaagggtttagagtaggccaaattgatatcatttcaatgtatgggggaaatagtacggagtcaagggtttagagtagagtgggttggtagtcggcacgttgtgcttttgggcaggcctcatgcttaccggataccggaggcatacacgaaaacactcatatatcactaccatatctcgtttggaaccaatacagtaattttgatcttctggatgaggcagtctagggatacccatgtgtaaagcactgctggtcgtttcgctctacagaccatacgtgttgggatgcattccacgaaggcaatggtaggcttcataatacagcgcccgggaagttaaagagctctctaagataacgatatgcacccaaagccgtttcaagttgtgaaggaataagttactctcgtattggtctcgattactcgatatttgttggtctatatagcgattgcaaccttccaccaacgcggccagggaagattgaagcagaagcctaatcgatagcaaacaatagataaaaacacaacaaagaattccatatcggaaatttgatgcgtagtagatgttgtgagtagtgctagtgtatatttcctacctcgctgctaaccacgatgacatcttctcacgtctagactccgggagactgggcctagtatcgccctcctatagatgttcttgttatgtggtttctcaagaagacctacgttatcttggttgaagttccaacaacatccgggcttgttcgccattgaagtctaatttcgtcatcacctcagacaaagtgagcgctagccaaacatctccatatatccgcacttgctccagccacttgtccaaatgatgtaatagagtctgcaaatcacagttaggtgctcatagcaggggagctaaactgcagtaatagattatgaggattgacttgatgagggtcaagcacaacatgatgtcatttatcatcatacaaacctgcccaccctcgaacgagtatatgaaaggcatttcagcttcatattgactaaggagtaccggaatattgacagaatttgacaatacaatcataactataatacgtatcagagccatcaccatgtctcctaagaagaacaccggcgcagagaacaaggtaagtccggagctctcccctgtacgaaacatacgtgtgctcatttgtcaaattagcgggaagctgccggccccgttccatccgagtccctcgctgccgagtcgtaccgcgagggtggtgctttcgccgaaaacgtcggcactcacctcgaagactccaacgcatccaacttgaagaagaaatcagaatctagcaaactagacgccgctcctggcaaaggttatcgtaaagggccccaagatgaatcctacgagaatccaaacgcccgcaatgttggtagctcggagaacatgcctgattcttacggtggagaggcaccctcctacgtcaacagccaatatgtcgatacccatggtccaaagggcaaaaatttgcatgagggattcgacgattccggcacgagagatggtatccaggctgctatgaatgccaaaattggtagtaagaatgatcctagccggctggccgagaacaagttcgagatgcgtaatagtgccaatcctcgggcgggtaacgagggaaagctttcaactgagacgaagtatgatggtcttggacgggatgcatccgcttgatatgaagttcctgagacggacttgttgactctacattgtcattcccaacgaatgactaaatatgtaggaggtttaatttgagaatcgaagaggtaaaatgagaataaaaattaacaaaaaaaaaaatgccaaacttccaccgtttaagtgtgcatttcctttttcgggtttggtaatacttcgtgcatgtccggattgttggttggatgttggatcaacaacctcagtccttctcccctacttgcacaaccatctaacagcgtaaccaaacgcgcctccctgactacctagcgaacatgtctatcctaattctccccagtgagctcctttatcgtattcttattcattgtctcacagtccggggcgtaaaacgcggtgtccggttgaggctggtatgtagtaagtgacttaccaccggcatttgttctctatggcccggctaatgcgggtattcagaagagttcgattatatgttcatgccagctctctatcaatcgcacattctcgactctttttctgcgccgtgtgttggctgggagtggtggccacgtaaagactcctgcgggtctatcaagctctggcatgactaccttgttttccgtgttcttagcgagcgaagcccagacgtaggacgctttattaaaattcgcaatgctgccaaggctttgaatcatctctctgatgatgctctctctctagatgaaaccgtccacggcctctgctggctggcattagagctaggcaccaactgccccggcgaacggcagctgtggttgaagggagacggccgcgagtgctgggtcatctaccctgatcattataaccctccaactgtcgagcgtgcgttagagcgacaaatggttcaagccagagaaccccgccatcgaatgcgcaacttaatctgctttgcggtgcagcttacttcaacctggtttcagcggctgaagatctgctacagcaaagccatggcctgaggtacgttcatgtcgattcagtcaattgctgtaccttttccctaacaaaactagtccaactgacggtggcggcctccttcctatcgccaatttggattgcctccttccgtggacatgtttctatgttagacttgtttcaaagacatgtcctctccaaggcgtcctacacattctcagatgaccaaagctattacgattgggcccatgagaatactaaggatgccatcacaggcgctatagccattggaaatttggatgttcttctcagcgtccttttcccctccaagtgtgcggccttctccgccacccatttttgaggcaccaaagtgcctacacggccaaagtctgatggccatgtgctaccatagagccttctcccccacgccgatcatgtatgattttgtcatgaatacattccctgacattcacgatgagaatcgcaggatcgagtaccggcgacgagacgagttggccaggtacgccagagacggcaaccttgaaatggtacgtcatctcatgagcgccagcacaaatgttcatagtgggggctttgtcaggctcgcaaaccccctttatcgagcgtgccagagaggctacgaggatacagttgaattccttcttggtcgcaatgccaagtacaatggtgacgtgctctttaaagccattagagtcggtagtttgaacattctggggaggctcttagaccacgatgcgacggttcgcaacgaaaaagatagtttccatggcgaagtactatcagaaatcatccgagcagaggatacggcgatacttgccttggttttggaaaggggctacatgattaccaaggaacggcatgaggacgcgatgaagtcagccatagcgaacggcctggaaacaatggtggaattcctggaaagaatcaggatagctgaatagatgtcgagcgggcatagagtctcaagctgtctgtgtaatgctaatgggtcacgtactcaacgctccaatttcgttatattcaccagatgcccataaggtgctgtgtatcgcttctttgttccctcacatgcaaagccagatgtgattaggtgaacacaacatttaggcagctgcatcttgggttgactctgtcatgcgccaggagaccagccaggctcaacatttttgccaagaaaaggctcttaactggctgcaagggtttcttccgcactggaggggattgctgcctgacgacctagtgccgtgtatttgaggtaggggacacaacatagttatttatagggtcattgcttagagatttgggacaatacctccctcctcttctctggcctcacaggagtgtgaacctgcaagagccaaaataaagagccatgcaattgtaattgaatagctcaagatgtcggaatatccaggccaaacttcggacttttgtagacgccatttagtaaacttgaaactctggcatgtgccactggcaaccagtgcttcacgagctgtatgtttcactcctcgacgagccacagatcagacaacacgtgacataaggtcaggtacattgacagagtttttccatgtctgaaccctttaacacacagaaaagtcaaaattctcaacaccatagactgtgctcaggcatcaacgtctccaaactctaatcagggctggctaatatataactcggccattgcccccgtatgcttacatccacgcatccttcttcagcttgctgcagaaatgtcagtatctaaccatagccaaggcctggccatagcgagagaccaagtcctgccacgacccgaatttccccaggtttccgactaagcacagatcaaacttaagctttgatggctcgtctccgcctaggactcaacacagcacatggcgtgctgaaaactacgggttgtatgctatatccgtgatgaattacgacccaacttctaagcttggtcttcagcacgcatgtgttgcgttcagccaaccctaggcggaggcagcccttgaagctcaagtttgatctgaggttagtacaatctgaacaaagagggaacgtcaggtctctctgtggacatgtgggtggagggaacccagcctgagaattggacaggaaaaattcatcagatagaaccacatgtgtgagaatgatgtatattgggtacagggtaggcaatactaaggtaaaccgggtcaagtgtgacgtcaaaaacaggggccacttggcggtgacaagcttgcctcttttttcttgccttacatgtgccttgctggagctcctggcgcatgaggggtgagacattagcaagccaagagcaagaactacgatcaggtatgggttgccgtgaaagggccaacgggtataatgcatacgatagtcagctctgccattgcattgcccctggcgacgcatgttcaagatccatgcacgccgcagcggcgaagatgagattccaatgcacgtgaaatccattcaattgtttgtgccttagcttgatgcctgacacggtgccatttgctgacgctgatggagggtcagtggccaaaatttttgttatcggccccaccaagaaaaaaatcaccccgcctcgcctccagacaagccaaaggcagcattctaggctttctcacacaccttcctcctccacgatagaccctggacaggaatagccatccatcggtactggctggtttgttttttctatcctttgtcgtgcggaccagaattttgtgttcctctttttctcttttcccggaacacttttcattgctcttgcggcttgaacccctcagagcatcttccacagccagggttttcgttaaccccgcggtaatctttttgtgacctgcgcagttcagtccgcaacatcttagaagcaccttcgatttaatttcttttttatttttcgctagatcgccaacatgcctccttcatcgtccaaggagaagcgacttgccaagaaggccgccgagggcaagctcaagggcaaggctggcaaggccaagaagaacgaggaggtccaactcgacgccaatggcaaccccattgttgacgagaacgcctttgccaccactggcgccaagatcgatgaggtcaaccgccttgcccagcagatggacgagcacggcatctctgaccgtgtcaccaccggtgtgctcgcctcgacccccaccagcaaggacgtcaagatcaccagcaccagtcttgtgttccacggccgcgtactcatcaccgactccaccctcgaactgtcttattccaaacgatatggactcctcggtgagaacggttgcggaaagagcactctcctcaaggcgattgccgcccgcgagttccccatccccgaacatcttgacatctacctgttgaacgagggtgcccctccctctgatcttggtgcccttgagtgggtcgtcaaggaggccgagatggaactcgagcgtctcgacaagcttgctgaagagctgctggagaaggagggccctgaaagccccgtcctgatcgatctttacgaggtaagctggaacgatcggaaagagactccctattgaattacttgaagccttactgacaacgagcagcatatggacaagatggacccctcaaccttcgccacccgtgcctctctgattcttaccggtcttggattcaacaagaagaccctccacaagaagaccaaggacatgtctggtggctggagaatgcgtgtcgccctgggcaaggctctcttcgtcaagccctctctgcttctgctcgatgaccccactgctcacttggacctcgaagcttgcgtgtggcttgaagagtacatgaagaagtgggaccgcactctcgtccttgtctctcactccatggacttcctcaacggcgtgtgcaacaccatgattgatatgcgtggcaagttgctgcaatactatggtggtaactacgattcgtaccacaagacccgatctgagaacgagaccaatcaggcaaaggcctacaccaagcagcaggaagaaattgcccacatcaagaagtttattgccagtgccggtacttacgccaacctggtcagacaggccaagtcccgacagaagattctcgacaagatggaggccgacggtttcatccagcccgtcacccccgacagggtcttcactttccgcttcgctgatgttgagaagctccctcccccagtcctgtctttcgacaacgtcacattctcttactctggtaacccagaggacgacctctaccgcaacctggaacttggtttcgacatggactcccgaactgccctggtcggacccaacggtgtgggcaagtccaccctgctgcgtctcatgactggcaagctgtctcctactggcggttccgtcacccgccacactcacttgaagctcggtctctactcccagcacagtgctgagcagcttgatctcaccaagtctgcccttgacttcgtccgtgacaagtacagcgagaagtcccaggactaccagtactggcgccagcagctcggccgttacggtctgactggtgattcccagactgccctgatgggcacactgtcagaaggccagaagagccgtatcgtcttcgccctgctcgccatcgacggacccaacatgcttttgcttgacgagccaaccaacggattggatattcctacgattgacagtttggctgacgccatcaacgcctttagcggtggtgttgttgttgtgtcccacgatttcaggtatgtttactctcccttcagtttaatccacaatatgctaactcggaaatcctagattgctcgacaagattgccaagcagattctcgtgtgcgaaaacaagaccatccaagagtgggatggttcaatcggcgagtacaagaactacctgcgcaagaagatgattaattctggggccgtctgattcggcggagcatgaggatacgacatttacaatcttattttatagagttaacgacgcagacgggacataaaattgcatgaccagggcggcttcacggggtacagcgtcgcgcggcttgccatcaggaatggcagcgaggttttttttttgtgaatagaaaaaaaaaagttcgacgaagccgcaaggacgccccggggggagctgaagatacccccctcgattttaccctcatccatagaagcggcttgtggcctctcacatgacctaacgcgttttcttgtcgtatgggatagaatggttgaattctgatttttttttgtctttctcatttctacgattttgggtttccgaccatgccagagaaggctgaaatagcttagtacaaaaatggcattcaaaagttgcacatagaagtgaatttgcctgtgatgaagccgtgttcgttggttcgagaaaattttgagtgatcacatgggagtagattgcctgattgtgcattttccaggcgcgcaacatgcaggtcctgtgtgatattgatggctggccgtcaatgcatgatgaaaaaaaaaaaaaaagaaaccgtgtctgggcgctagtgggatgggtgattgcgtgttctccgggggcgtagatacttctcgcgctttcgtggtgtgtggtagggtgagggaaatacgtattggataggtcattattctgtgacgtgccttcgcaggatggatggatggatggacggaacccaggcatttttgtgggcagtgactgaaagggcggaaatggcacgggagtatccctgcggtgcgcgtgagtgtgaggctatcacgaccccgtcacgtgattgaaacaagcccttgaattgttttggccatcaaatatctatcattgagcagagagatcttacggcctctaggcgactgttctgcttagctggtagtcattgggacaatagttggtgcccgcgtcgtctgaaatggctagggatcctttttttggaacctcctggcgcagcgtcgcagtggctggtgacggagagatgcaggattgccaggaggagctgctcgcaggcgttacagggaccagatactatttacccagctaatcttaggaaccccaccgtggatcgagagccggggaagcccgactcgcatgtccgggagcggagatggtgtcttcccgacagcacacactaatcgccaagtcagaggtagataagcgacaggtggttcaggggagagagaagagagaataagtgactgatgccgcccggggcagagtgtatattacgagtgcgagtggaataaacacgaaacttcgaaaagaaaagaaaaagaaaggcggggaggggagcccagcataaaagtgcatgcaaggcgtcgacggcttttaacaggggatgagaatcttggggacaaaaccagcccggtgtgtgagccgacaatgtcagggaagtggacagtgcgtgcatacatagtaccaacccacccgcggtgtgctatggacaatagtcaaggatcacggatgccagtgaatggcttttttcactagacgtaattattgagataggaggggagaaatgagagaggcatgcctgttttctggatactgttggggaagttgtccgcccatgttggtgtttgaagttttgaagaggataaggcgcacggtaagccacgtacgattctggcgggctgtaaggcaccgctacgatggccaattcaaggtgctgcggaggaatgggggagtcgagcctgagaagcgcgtgcgacgacgtgttggcttagctggccccatttgtggtgtcggaatgcgtccggcagtctgtgtgcccctggtgagcgagtatctggtgcatttctacctgatgtactacgaagctccgtgaaaaacttaatttagtgcctgcgatgttcggcaggcttgcgtggtcgtcatgagcttggatgcatgagagggagggtgctaataatcttgggccggctcagccatcacggcatgccgtacatacattccgcacatccatagtagcgacgatggtggtgatggacagggggttgggtgagcatgattatgatggcgatgattgggggtaatgtgtggatggctagctgaggtgtgggaaagatgcagggagaaaaggtgtggcgagctggcggaacggcgaagttttcgctcgccagtgtttccgggcgcgaggataacggggaggactgggcttcccttctttctccgccccttcttggattctgctcgccttctaatgcaagtcgataatgtctgatggaagcagccactcacggaggtaaatggcgccaggcgaacgacccgggagcaggcacaccgttggggaggtaccccgggaggtgggtgacatgggcattgatgcacgcactaaagcactatctccggcacggttcagctcgatttcagcgctggattggctgctgtgctggtacttattgatgaatgatgggacaaataggccctctcttccatcccagcgattgcatctgcttcattgtccctgttgttgggcgttgcgatgctcggggtccaggtaccatgtacggctggcggaagcatgcgggtaggtacctagcgacaggcgcagggtactggctattcctacctgaggagctagtgtcaagaggtacgtacaaggtgtgccacctaacaggtaaggtagggcgtgggaggtacctgacagcgggcgacattgaatttgggacactcacgcgttttcctgcttccctattttcgagtctgcgatgagtaccctcaattattgagcggtactaacaatgatatcggaggcgatacactaaaatttgtcaacttctatcattttacgcgactgaagattctggtcgttgtagaaagtggtcgcccttgaatctgatgtctcatttcttctgtcacccactagcctggcgggtggaaggcctgtgcaggttgccgttctggtggcctggggcagccgctggccagtaagattggccgagagcaaatcgatcgtcagaactctgaagctggaaccccaacgccgccagcagcaaagtgggctggctcatcagactgaccagaccagaccagactgacatggagacaggacagactccggacaacgcctcacttgccttggcccggaaaaaaaggcgatcggccagctgctgtagactcatcatggctgcctcttcctgcccacgtccatcatagacctcccctctcatcccattgcctcctccctccccccctcaccccccgtctcctccatcgcatcacgacgacgcctcgcgatcggcttcaaagcgtcgcccgtaggaaccaacaccgcgcggcaccacgcccgccgcccaccacccaccacctcgcggctcctcgcacactcctacctagggaggcgccgcggccacgaacacatcgcatcgcatcccaagaccgcccccagtcatcgtgcatcctgccgttctcccctccgccccgaccattggcaatgcccaccacccgacagacaggcagcctgttgatttccttttccctcctcctcacctcgggactcgctcctgccgcccactagactgtgcctgtcatccgagtagagtatcgtgcctcgtttcctcgctgtcgcagcctccatcatccactgcaacactacgctcgcctgcgactcgtacagtcccggccctccgaatgggcccagcgctcgccctttccatttgagcctagacaaatccccagacggcacccgaggaggctgcagcccagtgacggcgtgcgtgcaatcttattgacccaggtcgcagccatggataccaacgggttttattccaccgtgctgcacccagcacaccaggtcgaggccgaagatgaccgtggccgacaacaccagcgcgacacgatgagtgcagggagctctggtcctccaccttcgtcttcgtcagcgcaccgacaccttgaatcctcctctgccttcagactgcggtcgccctccagcagcgcccattccgaccaccaccacgggcacaatcccaatcccagttccaaccacaaccacaacgctcctcatccaccaccgccgtcctacacctcgtctgccggctcgcatcatcaccaccaccctcagtcgtcgccccagcatctccgatccagcctgcacgcgcctggcggcagcccatacatggcacaacaacagccgcagggctcgtcctctgttggcgggcccgtggctcccacgctgccaccgccctcggggcttgcagcacctcagacatcaacgtcgccgatggctggtgcaagccatcatcaccatccgggtccctcgccattgcacgcaccctcgggctactaccctcccccgtcgtcgtcggatagccatcgacacgcgcgcgataacagtggtagcagcagtggcagcgctgccaagcccacgaggagcttctacgatccaactacagactcgtcgtctcacgagcgtcgcgtctcagactcgtggcagaccacaacccccaaggtgagcaaacaccacgcccaatcccccaattcacgtcaaacccgcattgtacgtgacctgtccgcgttggcaggtccgtctgccccagtcaaatttttattgtacaactgcgactgctcctttgtgtcttgataaaaaaaaaacaccacgccattaattgcatgcgcatcgcccttggttctttcgcccccccaaaatttccctcgacccccttctttcatcaccacccaaaaaaatcccgaaacaagcgtccgcgcccatccttattagtgtgcaacgtgtgctgacctggtaaattttctctccccagcaccaaccacgcgaagcttactcctactcccaacaatccgataagccatcctcgtcatattacaacggcaacagctactcatcgccaaaatcatcaattcatcgccctcgcagccctttatctcactcacacccaaacccacatcgggggtcgttaagtccgcccagccgacagtcacacttggcatcgcccggctcgaagcatgcaggcgcgcccagcatgacctccacgtctaatggagcgtcgaccatggcgcccatcatgaagactgatcttgctgcaccctcacccaagcctacgccccctagtgtacgtgttttatctgataccctcttccccccttcaaccgtgtttgtctcaggctaataaaaacatttctcagaccgcaagccgtgcagaccccatgtctttctccaacattctcttaaactccgagcctgcacccgagccccgcgaacgacccgtggacgcggagcctcgtgagcccgaagccgatcgaaaacccaagatcgagcccgagatcaaggaggaagctgataagctgatgcctgatcgggatgacaatgatactgagttagaggccgaggtagagatagtgcccattaagaagagggaggtgaagaagaaggcaccccgaaagtcaggtctcggtcgcgtatccgacgttcgagacgaggccaccccttccaagcctgggcgccgcaactcatcgaggaaggaatcacctgctccccgcatatcctccaagcgccaggctaacggccaggagaaggagcaaaagacttggtcgaacgaaatggaaaagaagatccagaatgtcgataagcagatcgagaagaacattgccagcctggacaagtcggaatttgacgaagacgaatacaagatgcgtgccgccaaacgccgcaaggtcatgtccgatttcgatactgaccggaacgttcgtcgacgggaagactacgtgaagctggcaggtaggcgacttggagatcatgccgagctcggcaagaggcgatacgaggaaatgtattacgaagaggctctccacgaagtccgtgagcaagaggtctatgctgagaaggaacgcaagaaggatatgcagcgcaagcgacgccgtgaaaaatccatggccgtcaccatggagcagaaggaagctgcacttgctcgtgccaacgctgccgaagatgagaccgaacgccagaagcatcttcgtgatgccgaacgagccaataagaaggcccagcagacgaagttgatcttgcaaaagggcatcaagggccctgcccggaatgtcgacctcaaccttgatggtggtaccatgtccagcttccaagcctccgacgctgaggccagtggcaagaagaccaagcgtggtggcaaccggccgaagaaatccaaggaacagaagcaggccgaaaaggactccgccgaggcggctcaggccgctattgacgcaggtgaagagctccctcctcttgctcctcgcgaggacaaggagggtaaagaagccaaggatgccaaggaaggcaaggttcgtatcaagatcaagaagtccaaggacaaggagaagtccaaggacaagggcaaagacaagaccgaagtggacaaggacaaggagaaccgtgagcctggagccgaaaaggtcgacgacacgcctgacttggagaagaggtttgctagcaagggctacaatcagatttacgatcagatctggcgggacatggcccgaaaggatgttaataagaccttcaagcttgccactgattcttatgctaccaaggcgtcgaatctcaagaagactgctatcctcgcttccaaggaggcaaagcgatggcaactgcgtacgaacaagggcaccaaggatctgcaggctcgtgccaagagggtcatgcgagacatgatgggcttctggaagcgcaacgagcgagaagaaagagatctgcgcaaggcagcagagaagcaggagattgagaacgccagacgcgaagaggctgatcgtgaagctgctcgccagaagagaaagctcaacttcctgatttctcagaccgaactctattctcacttcatcggcaagaagatcaagacagacgaagtggagcgtagcaccgacaacccggacattgctcccgatgccaagcaaatccctcataacaaactggatgtcgccgaacctgacggccccatgggtaaggtaactgatttcgagaatctcgacttcgatgacgaggacgagacgaacctcaaggccgctgccatggccaacgctcagaacgctattgccgaggcacagaagaaggcccgcgatttcaacaacgagcgcttggacatggacgacgaaggcgagatgaactttcagaacccaacaggtttgggcgacgtcgagatcgagcagcccaagctcatcaatgcccagctcaaagaataccagctcaagggtctcaactggctcgtcaatttgtacgaacagggtatcaacggtattcttgccgacgaaatgggtctcggcaaaactgtgcagtccatttcagtcatggcgtatctcgccgagaagcatgacatttggggtcctttcctggttgttgctcctgcttcaactctgcacaactggcagcaggaagtcgccaggttcgtccccgagttcaagattctcccttactggggcagtgccggggatcgaaagattcttcgcaagttctgggatcgaaagcactctacctaccgaaaggatgccgctttccacgtttgtatcacttcctaccagcttgttgtgtccgatgtcgcctactttcagaagatgcgctggcaatacatgattctggacgaagcccaagctatcaagagctcctcgagttctcgttggaagagcttgttgggattccactgccgaaacagactactccttacaggtactccgattcaaaacaacatgcaggagctgtgggccttgcttcatttcatcatgccttccctattcgactctcatgatgaattcagcgagtggttctcgaaggacattgaatcacatgctcagagtaacaccaaactgaatgaagatcagctgaagcgtctgcacatgattctgaagcctttcatgcttcgtcgtgtgaagaagcacgtgcagaaggagcttggtgacaagatcgagaaagatatcttctgtgatctcacctaccgtcaacgcgcctattatagtaacctccgcaaccagattaacatcatggatctcgttgagaaggctacgatgggtgatgagcaggattctggtacactgatgaacttggtgatgcagttccgcaaggtctgcaaccatcctgacctctttgagcgtgctgaagttacctcgcctttctccttgagctatttcgcggaaacggcctcttttgtacgagaggggaataacgttccggttgcctactcggcacgcagcgtcattgactatgagctgccttctcttgtctggaccgagggaggtcggctcgaaaagcctggccaagataatatcaaggctggatggcgcaactcggctcttgcccacatgctgaacatttattcgccagagcatatccgggaaagtactgacgagaacaagggattttcatggctgcggtttgccaatgttagccctggagaggtctacaaggcaactcgtcagaacttgtttgcccgtgcggtggatgagctgcagaagacgaatcgcttgggtcgggtcaaggtcgcatacgatgatccggaagacaagggttatacaccggctcacgctctctttaacattgtagaacgcaatgaccgacagcctctggtggagattatgaacgagggcgtgatgggcacgctcatgaatgtcgctagagcagagtacgatgagtctggccttggccgcctggagcaggccgctcgaccgtgtgcgtctgctcctcctgtcaccgtctcttgcaacaagcgcagtgccgtcattgaactggacaatgtccttttcaacattcccatgcgcaaagcactgtacggcccggcccaatgggaggaggaggctctcgtggaaaggaaggtgccgcttgagctttaccccacgaagcagactcttccaaagcctgacggcgagttgaagcggttcaccaacattgccgtcccctctatgcgtcgcttcgtcacagacagcggcaagcttgctcacctggatgagctgctcttcaagctcaagagcgagggccaccgtgtgctgctctacttccagatgactcgcatgattgacatgatggaggagtacctcacataccgaaactacaagtactgccgattggatggttcgactaaactggaggatagacgagatacggtgcacgatttccagacccgtcctgagattttcatcttcctgctatctacccgtgccggtggtctgggtatcaatctcaccactgctgataccgttattttctacgattcggattggaacccaaccatcgactctcaggccatggacagagctcacagattgggacagacgaaacaggttacagtctatcgtctcatcacccgcggaaccatcgaggagcgtattcgaaagcgtgctcttcagaaggaagaagtccagcgtgtcgtcatccagggaggcggtgcaagcgtcgacttttctggtcgccgtgctccagaaaaccgcaatcgcgatattgccatgtggctggctgatgacgagcaagccgaaatgattgaacgccgcgagaaggagctgcttgaatctggcgagcttgataagaagccgaagaagggcggcaagcgtaagaagactgagcagcccagtctggatgacatgtaccatgagggtaagatatctcctgatatgtttttttgattggtttccatgactttttaggtcagtagctaaccatatttgctctttaggcgagggtcatttcgacgatggcagcaagcagcctggagcttcaggaacagcaacccctgccgaaagcgatatcaagggcaagaagggcaagggcaaaaccagtgcgaagagggccaagactacgaagcagagactagccattgcagatggcatggtcgacatttaataggacgaattcggttacagccccccggctgttgtaatacaggaactcttggtgagataatttggaactggcatgggcgaaaatggcgtcaaaatgaatgaacttgatttgggatttcgagggcaagagaggagaagctccccagtccctgaaccgcgtgggagtgttgaacttgattttaagccgagtggagaggagagaagtgtgcatcatgtgggtgggattgaattgggggttatagatgtttttttttttttttattctttcttttccttgcgattttttcttattgttcaacatcatgggaaagaaaagggactcaaaaaaaattatggccaacgttccttgatgatattggactggccgttttggtgtatgctccggagatagaggcgccgagtgtagtagtaccaatagagacgcgtgtatcatttctagcatgcccctgcacttgtgcccgatgaaaatcattcctttgatgaagtgttcttacaatgccaagacgtcacggcgaagctggggttgtgatatgttttggtaatgaacgttgtgttagtacatcacggcacctcagtcattgtagtagcatgcaagcaaccctttttcgtgaaatctccttgcttttcatttgagctagctatctgttcatttgaattccttgtgatatcaaaacgcctttcaaagtcccgttccctgcatgattgatgggttagctagctacttgaatattctgagccatgatgcccttcccagcttgccatgccccaaacctgttgcgatgctgacccagtgcgatgattgctagatcaaaaccttttttgagcagtatgatgataaatcaaaaacttgtcatgagaaaatctcccagtgaaggccatggcgggcgtccctaaatttcctgaacgtatgaatctaaaccaaatgatggaactctctgcgtccccttgccacctgcgctccttcgatcatttcttttcctccggcggtgtagcgtagccagactcctcttgctcagatccatcgcaccattcgtccttggcgtctccttggacgggtttcttcgccttgcccttggctttcttgcctggagctgctgcctttcgtggcttcttttctccctttgaggccttcttcggcttctttttctcttcttcttcaggcgcatcggccagcagtttctcgtcacatggcgggattctgattgatcctattttgctctcatgtgaatcaaagtactcgttccaactcttgatatcgttaatcagtgagcctcggagttctttgacctcggcagcgcaatctggggcgtgtttggaccctgagcagagttgtttaaggacctgggcctcgattttgccaagattatcaatcaactccttgttcatatctttgtattgggtgaggagtttcttccggctcgcgatcaattcatccgagaccttggctccaatagatgtgatgatttcatctccttctttgactgcaaagtcgtgcatggtctgaatctgtttcttggccattcccttccctgataacgtgttagcaaatatgaaaagtgaggataagagtggccgcgccttaccatgatgctgagaggcttcaatatagcccttccgcataggctcattcatgtagtctcgagacttgacgcgtattttgttgatattcgccctaaatcgagctgcggcctgaatcagcttagactgatgctccattgtcaagttgtagcctttataagccactcgtccaaatgcctctctatactctagtggtaaactgtcaatgttacaggtcgtatgcaggttgtgggagacgctttgcccagccctcttggctagaatgacgaaatatgccggaagcctcttggtgaaggcgaaattccagatatgcgccttcctagcccagtagtgaccgtacctacggagaaccaagaatgttagaggtatattaatctatgcagcaggttgtaatgatgattggccgtgcatgggaatactgggaacttacagtcttgcctcccagcaatgtgtctttcggggtttgtgtgatgtgcggtattggcgcccctggcgacgaatgcatgccgagtatgtactccagtgaagcctggatccatcgatatccctttggaacttatcaacaaggcttgaaaatccgttgatggcaagatcatctgccacgtttttgatggctttataaggttccagcctccccatcaaactctgcaagtttctctcagatttttgaagtttctactcgacaaaaacagtcaagtcagtataacaaaaggagactccgctcaatatataaacttacatctttcagttccagagatgttcccttcaacacttgttcaatctccgatttagatgcccgaggcaactggaacggagacctaggtttgtctatagcccactcttcgatcgcatcaaaagacactttgcatcggtaaaggatattgtcagcttgaatttctctgctttcaagagtagcttggacaatccaatcttttaacgcagtgaaccctgttgctgtactactagggaagccgtccatgggggcttttcttgtgaggctttgctgagctttactgctgacaggaaagacggccaacacagtagaagcctcttcagtttggcgagcagagttgcggacctggtcgaagtaagcctgcagagcctccacactacccttggatcgtgattggatgcaatccatcaagcagcggttgtacaattccttgacctcggtctctagggtgtggcgtaaattcatcgcctgggtcagctcgggggaaggctgggaggaatcttggaccgcacgctttgaagagcaattcccagaaataggttcagggcacccgttatcttcagccttgagagagactattttttcctgtagatctcccaaccgttcagacttctcctcgtagagatttctgtctgaggcaaaagatgggctgatggaatctggatctgcctctgtattcacatacttttcccagtcgagctgatcaaccttggtgatgatgatagcgatcgagttatcatcgagcttgccgcttgcttctaaatcgtaaatttggtctgcacagatgagttccgtggccgttcggttgtcttgagctctgtcagccggagtgactatgagcattttgtcgagcttgtcgtaatattctctagcaacctgcgaacgggaatctagagcatccatttggccaggcagatcaaccaagactaggcctgggcatctggagagaaggggagaatgaagccagattttgacgagctcgaccagtggccaccggagttgtccccgctttgcattcgaaacagagcccacaaagggcgtcacttcccgcaagaacttttgagcgttatccgcgttgatgacctgctgcctggccttgttgggctcggaaagattgaaaagcatgtccgcactctgggaacagcttgtgatctggtcaatttgatctgataatccaagctctttcacctgagcaggactgagtcctgaccaaccgctaataaccttaatttgctcttggaatcgaacttcctcagttcttgttatctcgtctggaccttccatgtccactcgatcgcggtgatctttcatttcttggaacatagacgctagttcttgttcaacggcttccttgctcttgaatgtaactttggccttgaatttcggcttgccgctctccagaaagtgattctggaagcaacaaactgccgcagtgcaggcggcctgctgggaacttggcgcgatgtctatggtgtcatcaatcagggtgttcagtaacatcgtcttcccaaggcctgtatcgccgcctttgataagttagttttgagaatcagtatttttcaaatagtatcagagtggagtaaatgaacctacagataccaatgtgggtagaaaatttcacgacatcttgctcaatgccttctttatagatatcattagcattgactcatcatggtagtggtgaagtccttacggtatgtagagtcccatgtagacaagtcaatatctgagggcttagctttggtctcagtgatctttcgtgagatcgatgccagattgtctaagagttgtagaacggcgtcttctttttctttcaccacatcctcatggctcatctctgggtgttccggatttggtgcctccggaggaggcgtgtcgcccgacatgatgagtgcccaaagagctagaactgagagatctaggcttcgaaagaccactcaagatgatattggtggttggggaccaacttctccagtgctgaattgtgaggtgcttcaataagcaagtgtgtaacgcgctgcgttaggtattgaaagtgtcaaggaagtaaacgaaacttggtagaggctggggtagaaaggtagaaagctgaggttgactggagatgaaagtgagaagccggaggaagagagaagagaggtggtttatactgcaactgaggccagtggctgcctgaggaatctaacaggcaagagaaggagccaccccgggaaattctcagaagaaagtgaaaaggttctgaaggaaggcacggccgagtgtagggaaaagtgaaagaagtgtgaccaacctccggcttcataggaggcacggcaggcgatgcgacacaactcgactcggtagcggccagtcccaagaaaaggaaaggaaaggaaaggaaacttgggctatgaatatcaactgtcggagcagtagatgatgttgagttccaaccttcaaggcacctgagctgccaaggcgcttctcagaatataagactaatgcagggctttacagaggaacctctcgttgtaggaattgagttgacactgcgtcgccgacacaggcggattcaagttgagaatatgagatcgttctcctcctttgctcttccaacaaaccacagaggtgaggtgtataaaacttatgctcagaatttgatctgaacaatgagatgacttttggtactctagctacctacccgaaagaagctcttatctagattgcctttaccctccggcacaccgcagaacctcagacgacatcttgtaaggcttatgaaaccgagcaaacgttatcaagatcggagaactataacagacacaaggctaactactggctcggccgctcctcacggcagtgcctgagaacgcgtgtggcgactcgtgcttggaaccagctgagtacatatcccccttctgttgctcacccgccattctagaggcattccctgagttctcccctctgagttgtagcccagagacaccccgtagaagaaaagctcctagcccatctgccaacttcgacgcagttcgacgcggccattgaggagcagcgtgccgagatctcctaccaaggcatcggctatggctacatcctgtcttgctacagccctgagttccttgtatttctccccccaggttttaatcctcggaggatccgcctgggctaccagcagattaggggaatccgccctcgactcaaatcttcggcatgtttcagatcttgcgcctcaactacctcttcagttacgtgatcctcgatggcaaactcgacgacagattcaagaagggaacagaagaagaaggtggggagcataccgacggcggcgaacctgaaccagcacagccctacacataaggctggctcaggtgaaccaacgtgtagtgggtagttgatagggtcaagtgttcaggtcaaacatatccacacaggaactcaagagaaaggacaaaataacagggctggtcctcgatttttcacgggaaattaaacagcctaagagtccatacactaaaagaattacagaaaaggctctataaaaagaaagagaacttgccgccaaaagcctttgctcgaaacattgcgtcgtgcatgattgattcggccgtcttgtgggctctacgtcgctcctaggcctcagaatcacttgtgccttcgacgagacgctcgtctggcagcatgattgctcggtcaagctcatacggtagcccgcgatggcgccctcgaatcatcatgatgcatatcacaactttcccgaacggagtaaatttcccacagagggatacgttgacgttgggatatccaaggctcagaccgacattggcgctagagttaaccgttagcattctggaaaaaaggaaataaacatgggatggatcatcgtactatgcagacgtgacttcgaaaagtatagaaaacaagttgaaggcctgtaggtaagaggatcagtcaatctgcttgttgcgtaacagccgcatccacacgacgggagaagcttaccggatcagccccatccatgatcttatcggattctgcaatggagatgcagaaaactcccaaaaatatgtaccacaagtcaaagctgagttggttctgcatgtgcttcaaaagatacgatgggccagtgctttcagactcgtccacctcaatctcgggaggttcgtagatcccgagcgaccgttcctcgtatgtgtttgacgctcgtatgctaatggctaaaggaaatacggagatgtacatcatgaccagaagactgagctgaacagctggattgacatccgagaggacaaacgtcgccgtgccggtgtggcgggacgaagcagcctggaaaatcgcagcgagaatacgctggccgaccgggagtacagcaacggcgggattgtggagatcaagcacgatgatgagaagcgtgtccacgaaattgagaacaaaaagaatgccaaagagaacccaggtctgcttgctggggaagagtagcgtataacatcgtcgcggatgctctaggaggaagttgagcggttcttggatggccgagtttcttgggaggacctttgacatcgtccatattgacagccgcaagaagattgggtagcaggtgtttccagcaaacgcgagaaagctcataatgaccattggccattctgcgtctctgaagctgatcattgagtctggagtgagtgtgaggcccagattgttgaacatggtttgtgccgagtaaaaggccctacgtacatagtttagataagagcccagcaaactggttctcaccgcagaaaagcgtgaacatcactcaccaccaagtttcagacaccgcacattctttcaaatagtccctgtacttggcatccgaatacttgatccatggaagtagacaaatggcgccgaagagatgcagaccaaaaaagtaagctaatctaggcagtcagtgaaccagacctgctaagcaattcaggtggcaacctactgataacgattttcagaaggagtttcaaacttctatattcgatacccccgagtatttccctgtcttccgaggttaagttcacgaataaggagttccgaccgatggtcgcttgatttgaaagatatggcaggctattgagggcgggctgttgtaaagagatagaatttcgtcgctctcgaggggggttttctcgtccaatgacgaacattgatgaagcaaacgtagcaacacgatcgactgagcgtgactcggcaagtctagagccttctgtaaaacggcgccgtaaaccagatcgcagactcactccggagatagcatctgggtcgcgctctagaacgagagacttagacattaacaaacgtaatcactccgttgcatatgagtagcttctcgtttcataccgtcatgactttgcgaaagagtgttgttcagctcaatcaaaggatagcctcggtcacggtcacgaggcccgggaatgtaaagcgttgcatcattcttaggccgatggtccgtggaaggttcaaaactgatgtgggcacgaggctgggaaggcttttcgttgttgatttgattcccctcgccatccttatcctggtctgtggccagaggaagagtaggaggtggcgaggactttcgttcggtcaccgtgttttcaatcacaccttcattttgtgttgtaggctcactagaaactcttggctccgaaggtgaagcagagcccggcggtggtgaagggaggggaacgcgtccaatggtttcgacatctcttgctctctggctagaatttgtatttcttctggctgaaagtagatctggggctctttttttcaaatgctttctgaaccaccagaggcgtactatcacaacaatgatgttaatgaagccaatgttagtgacagtcggcagaaaataaagatacagctgttgataagttttcagctctttcaggtccacactgttcggcgacagcgagtgcagattgttagaagcttccaaaatgatccttcgtgtggcttgttacgtacgtattcagaccggactcggtggtagcgctgactccaaagtggtaggtgtcaacagcgctgagggtgccatctgggtagagaatgggaaatgacagcaagccaagcagaatgatatatgtatctgtttatatctccatcgtcagttattagggactcgattgattacttgattatagcttgtcttaatgatagtggactcacagtgtagagacacgaagtttatcggtgggcgccacatcccacacagacctgaatcaagagccagggaactgtgagctctgaaggtgacggagtcagatgggacgtgagataagaacgtgtatggcgcttgaataagcccggcaagaatcaacagagaccggcaatgagaaagagtagtgcccttgccttgctcgggaggcctctggaccagtcaaggtggtgataagttcttttgaagtaggcctttgaggattacggaaattctggcaatggctatgatcaattgtctcgtgaaaaaaggagaaacatctcatgatcaactggttgacacacgggatccgacgatgcacagcctcgcatgatcagtcatatttctttaccacccacttcacccttcaggtaagacagagaccggctaatcgcgcataatcagaatggccattgccggagtggcccggacactggggcctggagcccaaattaggtggccttccctttcccttgggctgggacgctgcgcgattgtgtatccgggatcagcgtcgcagtagttgggtagtaggaggcctcttgacgctggggccgggagagcgccataatcaaccacaacgaccaccaattacagccgattggtacatgatatatgcacgtacaatggctgctagataagcttgcaggttgtcgctgctggctacgctctgagagccgggaagaacccgcatatttcaagcttaagttcttggttgttgaaaataggtgtggctgttagctaacaaagtcagtacgcaagtggctacaagctttcactgcgataaagagaagaaagagaaagcgactgtaatgaaaataatccccatgccaacaaatacggtcttaacactccatcccagagttgaatataacttaattccgaaagagagggtacgggaatgaagttggggcctggtttctttacattggatacttctattctcccgagtcaggttcagagcagagcgcaagctgaagccaacgggcacgattagtcccttctcttcttcatgtcttgcactgatcggttgacacgctcgatctcctcttgggcaccatcccacttcttgcgcttcccgtcaaagaggcgcaagatatgcggtgtaaaaatgccatccaccagcatgctgtaaagtcgtcggttctggaaccaaaacttccaccctgccaaaccccatccaaggcgctcgttaagaccggtccctgccacgtcgttggcccaagtcaaccattctttttggtttacccacccaggatgggcactgccggtcttggctatttggatggtcatcttgtgctgtgcatcgacagccagattcatctcttcggttgaaggcagggcggaagtgcctttccatatttgcgcaatagacatcgtggccaggtcgtatagagggaatgccccagttgcaaaggctacacaaccgaggaaggctaacgattgaggatgttccagagagaaaacgtttctatataggcgggggagtggtttgcccctggaccccatggctgcctcccattctggcgacgtgctgcgggttgggtcgaccgcggcgtcgaggagtttgaaggtgtgtttatacccagtgcaccaaataatggtgtcaacatcgacctttgtgccatcatccatctcgatttcgttaggccctagtacctgtttgacaccatggctgattggttgcaccttgccacttcggaaaaggtcaacgatgttgtccgagataactggcagggcgttcctgattgacggggctggaatgatgcgccactcggggtcgaatttgaaggccgagctcgacattttccccaaccccttatccgtcatgaagtcaaaaactgaagggaagttggtctctagaaatccgaggatattgatcttgcgaagcgtcatagaatgatcgaacggcactccggctaccttcctgggcaactgtagatgtgtatgtgttagtctcttcacacaacaaggcagagccattgggactcatgggtagatggattggccaacgaacaatgactgccccatgtctatacgacagatagactttatcagcgttcccaacaagtgctgctgcggtgtccacgccagtacttcccaatccaacaactatcaccttcttccccttgaagtcttctggcctatcatcgagacgttagtggaccgagtctgaggacgtgccaaaggtgaggttttgacaaacctcttgaaggaacgcgagtggacgctgtttcccgaaaacttttccatgtttgggagatcgggaatctggggctcctgttgcgcgcccgtcgcgatgaccactttatcgaagaagagaagatcagagccttcgactagtagcttccatcgatcggcttcctcgtcccgagtgactttctggatgttagtgccaagccgtaatctagatgccagcccgaagtgctcaacatagctctccaaataatcctggacatctcgagcagtacaatgacttggggcatcttgagggaaaggaaaatcggtatagcatccccgttctttagaaatattgatcaccgttgctaacgatgcctattagctggggtccgtatgagggacactgagaacaaaggcatggctgtctcacttggcagaaccgatgtcctgtcctcctccgagaagtgccacaggccaccgacaaacgggctacgctcaaaaccaacgacattgaaaccctcctcggcgaggtttttcacagccaccagacccaaaaccccttaaggataagcgtcagtgatgtcacaacgcgtttgcatcaaatgatgcctgggcaagatattgcgcatcctaccgagtccaacaacggcaacagacggggggtcttgtgccatgattcaagagagagaagataggaaaccctgaccagtcatagacaagtacgagagcagatcctttgcttaaccgtggtatggaacgtgttgcttgcggagaaattgtctcagtggctggagaccgttagtgggcgagctaaaccgaggctgtggctttgtatatattgtgatgaagaagccaatatgtgcggatgcttcacgagatacaagagggaaggaggctgatataaatggccgaacgaagccaccgatcccgaatagagctcacacgacaaatacgtgggttgcccagcgagggagcctaaaggctgacttcatgtacccaccaggtagccttgatggccactttcaatgggtcttacccattgattcatgcggtatgaccagcttgagacttgccatgcgagccgcgtggtgcggctgaactttagcgtttaggttaaatggtctttgtgcggcgtgcctccctggccgagaattatcctcattggctgacttccaggcagaaattgcaccagaagcctgtgttgatggttttcatgataaagacgataggcttgagcggttggtagactcgcctagttactctcccgttggaggaggactgtgaaggtctcatctggaataggccaggggtagtcgaaaggaggagcgagacgatggtggggcatgatcttatcaatctgatcgttgcagccagggtctcatcactggaagtcttgccatgcttggcgatctttcttcggacaaacaatctggccggtcctgcttgtgttggctcatattctagggacgccggcctgacgggaggattgtgtctccgatgagcctacccttttctccatcctataccccctgacatgccatgtgtttctctgcgtcaattataaatggagcttgtgggtcgaggggtcgtagcttagatgtttctaggcagtaattctgagtacgaggctcccaaactggatgccctcatcggatgatctcgccgggtgctcgagtgccgtatgcaagtgtcggcatatctgaaggaggccgtcaaaccggccgagccgtcagatcgtattcgccgctctttatgctcagcccgtgggtcttgaataaattcttaactcaccctgaaatgtctccacaggcccgctcaagtcggcattctcgttagcatgcccgcgagattccagggcgcggtggtcgtcgacgaagtagaaagggaggattgacgactcaagttggcaattggattattctgtctagcaactttaccgcattagaaagtcatctggggatgccaagtcatgggctgccacttaccatgaagattacaggagcatccctgggccaaacaccatgtctgaggtcttgctccgggtagacgaatacttattcgcctacgaagctggtgttttcattgaggggagtagcgagttgcccgttactagtgcccaatagaaggtttccagcgaaggaaagaaggtccaagtctccaagattactcttggcaatggaacgaaacacgccatttaggagtgattctgctgcgccggatccaaataggcaatggcggagtgaactaccaagatggcgtccttttctgcagctagggatctcttagtaaaccgagtggtctgtttgaaatagaagctggctagactcatcacgtcaagcttggcttgtgatgacctttcaactctgtgaatgatgttgttatccacatcaatggcagcatctggttcacaagcctaaaatacggtttcgagcaagaatttcgccctagactgagtctgcggccgctatgtatcgatttgtccctagaacaaaggcattagatctgtgacggatagtttcgaacatcctaacggcatctgcttttcacctgatgagaagacggtctatattgccgacacgggtcagcaacacggccagtcagtgaatattagtctggcagcctccatgcaagagaaatccatccaggtgcttaccaacaaacttttcaagctgggtgggtgttgcacacacacgataaatgctggctttgttgacgctatgcttccgacgtaaaatactgccatgggtagccgtttcttactagtcgtcgtttgtttgcactcgccaacatagtaatgcctgataagaccaaatgtggcacatatataaacgtgtagagcggatgtggcgatgaaattaacgtgtggtcggctggtggcgtgttgctaggcaaagtgctcatcctgggggagccgccaactttgttttggtcgagacgaagacaagttcgccctgaacgatcatcgaatctgaaaaccaaggttaatccgaacgtaaaaggtgctttgcttggggattgatcaagtgagaacgtcgacgagtcagcaagcaagtgcgtcgacgagaaggaagcgcaccctatccggcaagtagagagggatcgagcgaagaaaaaagagagaataccagctaccaggatcaaggcgcctgtatctgaataggaatccgttaaattcgtagtgcagcagccatattccccaagaaaaagagaagtgtgcttttgctttcctgttgttgcatgagtacaaagtagcacgacccacctggagggctcaggactgacgcttgggcacatctctccttgtgcagcccgccactgtcaagtattcagcactggcaattcctctattgccccctaggatctgacctttgctaacagtgacacccctctgcccattgtaccttttccaattcactctcttcttccatggcatgctcgcttgcttgaacaccacagagaactcctcgctgactgatgcatcatctacccaagcccttactgcatcttctactcacaatcatatgccccatgccatgtttcctcgtgaacttcgctcccttgcagaagtgatccattcttatttctacccatcttgtggaggggatatgactgcccaaccaatggcatcggcattttatttcttattgcccaaaaagtaggcaccaaaatgtctcttccgcgtgccaccaaagctggatgttgaagaaaagacgcgtcagattcatctcgactagacctccccatcaaggattttgaatgctcctcttctcaaggtgatgcaaagaggaatccagctggtggcttcaaactaacgtcattatgtgttagacatcggtatgaatctacgttcactacgttcgactttcgaccggggccttaaatcgtgaggggggtggtgatgccatctgccagaaatttgaattcgcctccgaagacagagcagtcatgaacatcgaacaacattccggcgcccttgactcttgtccacgtggagcgaggtctctccgagtagaacgaatcatcgaattcttcatatcattcttgctgatggcctgctctaggatacaacgtcaagcctgcggaggtgccttctcgtttggacatttgccgaaaggagccttctctcctcactctcgactacaggtacttgacaggcataggttgtatgattcagattaggctttgtggcctctcggacaacattgacttatatttagtgatgtcggatcagttccttctgttgacaaccccaggactacgataatcatacgcccctcttaccgatgacaaattccgatacatgaccaatacacttgactctaagtctattttattctcgtgagccaatactgttgaatttccgcccgacgtgaagcaggcagttgacccctatttctaggcttttttcgcacaccgcccggttctaaaccgaaaatgtaccgccgccgaacgatcgcccattgatacaactttcgacctattcgattccctgtcctttcgtcgtcgattccgaacgtaatagatagactgaataccgttatcaagacggcataaggaatgtgtcttggggcacatttccagtaacctctaagtccgaaggaatcaaacccatcacagcatattatacttccccaagactcctctcagagatgctcggagagaaagtactagtaggtccatgaactgaaagtgttggcctttgcaatagcctagttatggcacacagatccgcagttggccatcaagcatcaatggtagatttatcaacctcgtgcacctctcggtccaggtcagccctaagaaagaaacccttccactcctacgaggtctctcaaaaatacatcggaagggaggcccaagaagctgaaggttagagacaaactcctctcaatatgttcactctggacttcttcacccaaagacaaagcattgcacagtaaatcaagagttggagcttcgagtttttcgtgatttagaagctgaggttgactgaagaatgctgcccaagaaccatcgactgaatttctttcggtgctcgatctcatctccttctcaccacaaacacctccttgaatgtccaaattttcccaatgccttcccccaaagtcccctagattgcccggcttccttcctcctcccctctcctccccattccgtcaaaaaaaaagaagaggaaaaaattgaaaatagaattggaaaataaagaccaaaggtgaagtggtaaaacaacaagaaaattgggcaaaagcttcattacctctctgtttgtttttggccgattatggctgtctgaaaacaatgtcagtaagactgcctagaatagtgagggcagaggagacttacaaacttgatggatgaaggtagccaccacgggaccagggttcaatatcgatccttcgaaagaagaatgcagtgtgctgtgaaggagttagccgaggtagagctgggcatgtctgggacttgatcactaaccttgaataatgctggcaacggccaccatgatttggatctttgggctttggagagtgcagcgttcaaggttgtcttgcgtgatgcggaaaactggaaagctgattagtatgcggttgagactctaggaagggggttttatttagccctgaggtggcccaatgccaggagaaggtcagtgacctttggaaagcacctattcacttgattagcgtggtacaatctgaggggttaagaataagttttttttggccacagctagccggataacctgagaaggtcagcgacctttggaagtctgaagtcatctagacacttgattagcatggcacaaactgggggaatggaaggatggcgatatgtagttatctgtggtctgtgaagccgagatgaatggttggtgtgaccaggagaggaggagtttcaatgttcttttatgttatctagagagacacctggttagcaaaatctaaacatgaagggatgatgtgtgtgcatgagcagaagaagatgatggttccatcaagccaagaggctttcttgatgaaggatgaatgcgtaatctgatgaacaagaaacaagtggaaggggagatgagtgtgtggaagaaggaagaaagagttcaggttggagcgagggaggggggagtatttattggtccccatccagcgacaggcagaaaatccgagctactgagctcagactaatctcattgtcacctcaccttgaatagaaagggaaacggggagaggaatagaaaaagcagacgcacaatactcgaggtgagtccgggaggggggtgacctacgtaccccaggacccaacaataacccggctcacttgaccctgcgccttgcttgtgacgtttaattgcaccaaatcatcacctacaatgagagggcaagttttcaattgattagaatacatatccagatcattgagatgactagctgcttctatccagtacagttgatagtatgctggtcaaggtcacgccctttgaaatttaacgatggaggcctcgaagtgggccttgcatttatgactgaataatacgttcgttgtgtgaatccaatatcttacgcatgcctttcagtttagctacctaggtaaaattaggtgacgttgacgttgagcagttgtctgctcccagctgctttctcggcaggcccagccacccctctcatcttgcagtccctttattagcatttgtgagcagaccagtcctgtagcaagcttggagctactattccagagggcaatgtctactggtagtgaagcgggtggacaaaatggaactagataggtagccttatgccggtaccgccaactgtagccagccagcccaacggcttcttgctacctagaagtgtgggccatgcaaaaatccttgtcagatgccataatatcatgctacatgtgccataaaccgtcttctagatctttctcgaaagtttcatgttatttgttttctgaagcagaccaacactagccaagtctcgacgcccagccatggatctgaatttgtgaagaagaaaaacacagacagctaagtacattctccattcccctgagttcatgtaggtacataggtcgaaatatgcaacacaaaccgacattgccttatttgctcctcgaatctaaccctcgaacggatcaacccacgagcgtctctcctcggagactctagctactgcgcgcttggaggctccagagatcagcttctcgcattcaccgcgagttgatctcaagtgcctgtacagcctgcaattcctccctcgtccctcacaccgagcctgagcgtcaatcaggcgccgcatcgacctgtagcttgtgaacaaggaaagactcttgccagtaggactctcgctagtgggtgttacaattgatattgccggatattcattctcgtatgcccggagagctctgagaaaagatataacgcattttttgttacagaaaggggcaggggggtcactgcgagcctgatccagcaatttcctcaaatctttgagtaagagggtaaacagccgatgtcgagtaaacacgacgacatcttcaccgcattatctcgtcagcacatccgagtgaaacaagaaagctcagagaagagagagaggagggaagaaacttaccaagcaagttggtgctgatcggcaggttgtacggatcgaaagggcaattgctatcgtggacgagtgtggaaaacaccttctggaccagatccacgtccttgaaaacgcaagcaattgtcgcatatttcctgagcgaatgagacatttccacattgctggggcgtttcttccccaaggccaaggtaagggggcggatcattctcctcaacttctcatggcatccataatactctagcatcagagctaattcgaaatccgtatgaaggtcattcggggatggtggtagcctgctcaaatctttgaaagagatgccatcttcggtgtgtatagccgtcatgagaatcatcatggctctctcatcccatccacaggccgagacgacgttcaacatcctcctcgtacctcccaggccgctttcccattcgatgctaacgtccagaatcggtacgcaacgagagaattgacgctcaaaatatttcgtggccgatcgaagcttgtccattgaaactagaatcgtggttttcgttttgagacttggatatgaatccaccagagcagcttcttgccaccgagcactctctcgtctcgcagcattctcggagcttcggttacgttcatgcttgagatcgtcgaaaacatagtattcatactcctttgcatcaggtgtaatgcagaggggagagtctgggtggtccagctccaggaccgtatccccatcgatgtcttgttctcgcatcatcagtgaaactgcggaagatacatgatggtattgaaacgtcggctgaactcttggcggtagattgcgccttggtaccatttgcccatacatcttcgaatggttttgaggaggcctgacgctatgatagtaaacagagtgtgatatggcgagctttcgggcgaaaacgactactccaacgatacagaaagtagaacaacgaaggattttgagagtgctagcccagggagggttaagtattcatgggctggggggtatgcctgttactgttaagttactgttcatcgctcaggccttgctgtacgacgtaattagtgccgagaaacacaaagtaaaggttaggcagataaatgaatagcttctccaaataccacaggtgttaaataaccacataccatagggtgttctcgattatttggagctgtctccctggccccggaagagaaaggacgagtatgggcaaagaactacatcgaaataccaatacagttggcaaaacaatacaaagggatggcatttcatatttggtttcgttcgggtctacgtactcacattataaaacggcataatttcgacttcgtgggacttacgggtagctgctgtgatggcttgcttaattccacgcccacgttgatctattgggtattctgttgctgtaccgtcactttcgatagggagggagatggaagcctaaagagcagggtaggacgacagcttattctcttggttggctgcagctaatctaagtacctatccaaggtgcccacccggtgcttatcgaatattgaagggcctaagcgttcatcaaacaaagaaagattagcatacccttattgaagttggactaggaggatgtttcgccggtcatgaactgggagagacctctaggcggccaaacaggtcaggttggaaggaggcagactctaatgactacagaaaagcttaattccggtatataaatcataaatgagatccatgctactttctagctctagaagcgtccttttccattcaagtctcgggctgagcccttcctatgcgggtgaatatgcaagcacccgccatttgacacaagccacctccacctcatttctaaaaaccggttttgacagctcagtattacatttctagtccagaaggttcttacgattcggcatctatccgtgtgccaagggggggaggcatggtacccgtcccggggtgacatttactgttttggttggacggaggagttcgattgcccattcaggattccatctaacaatcactatgggccctcactacgtgaatactaactttccataaatcaggggccacatgagccgactgaaactttgccgatagagagccctacgtcgacgagtacagacagaaaagcaacacttgaaccacaccgacaacgccaaaccgacccaaatccgaccagcagcagctctctctggtgttttccacggataaaaaaaacaacgcagacaccgggctaaatcacaacacaaacgaaaatcaaaactgagaaatcaggcagccaagttggacgacaatagccacaagcaccacaagctctctggcatctctcggaaaatatggatcaagagcagtcctaacaacgaagacggtatagtcagaatcgtctcgaagataagaagaacactattaacacttacggtagtgaacgaggctgtcaagccactgaaggacgcgaggggggataggaataggcggcaagacgaccaggccgagagcaggccacacaggaaggagatcacgaccgatggtcatttcggcaggacggatgccttgcatccaggcctcgagaagcctcctgtttcctcggcgggcgatgaaatcgaggctcacattctccgcctcgcctccctcctcgccggtgcgagccaggaccatccttactatcaggctggcctgagtttggacgacgtttccccggcggccctgccaacttagcaggccatcgtcgtcgatgaacatgtcttcggtgggcacagaccgcccgatggctcttgagagcctctgcaaggatttcgcatggacaacgggaagccagcaggaaggcactaccggctcgaggtaaggagttacgttgtcacccattgttgatttcgtgacttttccgacttgtattagcgaaactgaaaacctaatctgcgagaggaacttggatgacgactgacgggatgggaggtgacgacgaggaaatgaccgaaaaacaacgagacagcagagaaagaagtcgaggctagaatatggtaagggggagcccggaatgtatgcaagtgaaataaaataaaaacgagcagtgtcaaacttaccaggaagttggcggagagagaaatccagaaacgattgtgatgatgactggaaattttggaaagaccagattcaaattcgaagttgcttttatcgagcagataaagtacctaacatagcagagttgagggtcttcctggggcgtgacgcaaggagctggggcaaagtgactgacacggccgtcagaagaccagccttcgtcgacgaacactgctgtgcagctgtcaacaaaccccactcgtttcttcacaacccctttcatagcagagagtggtcaaatcctgggcgatggagcgtctggcaacatcatgaaataaattatgacgttcgataacaaggccaaagataacaccactcttgttattgttctagctttcagaaggcaagctcgctcatcagtacactgcgtgctaacgggccaaaatcacctggaaacgagtggttattcagtcctgctaatctctacccaaattcgatactaacaaagccactctatgccgcttgtgcagttttgtcctcgtcccctttgatctcattcttcaacacaatcgccctcgagctatttttcaagtggctgtcgatgctcactgtacagaacgcacagaaagtggccaaacctccgaacccaatagcaaccagatacacgagtctaaacgcttctacgtttgctagctttgtgtgatacaaagctagctcaacaagtcgaggtgtggctccttcgatccccgagaaggctgctttggtgttggtcgctgcagctgtgaccagccccttgaggagagagttcgagaacggcacatctgaatcctcgatggccgtattcatttggccaggtagggcctggccgagtttggttgacagaatggcagagtagatggctgtagcgatggcaccacccaggagtcgaaatgtccccgcgagaccgacagcgataccactacacccattcgttagtatttcgtgaacaccatccttaatacatctgggaagtttcttgaagctaatcttacatgtctgattgatcctctagaccgagtgacagcatcgcgaaggataccagctgaggagccgtgaccatggcagaaccgataatgagcgtcacaatggcctgaactcgatcgtctactccgaccgaagaaagagaaccgatgagagctgtctgaacaaccatgaagaatacgagttgccacttctcatgacccagccacgagcagacgaagacggttgtgacacctcccactttgcacaaagtcagcaatccgaaccgtcgacgaagatcctactggaagaatacttacaccaacttccgatcgagaagaaagtcgcatagccgcctcggagaatcggctggtccgcgcccacgaataacgtctgcgattgcctcggccagagaacgttcatgctgtagtagagcattcctccaacgaaacaaaccactataaccatcacaaactctcgaactttcataaataatttcggtgggagaagaggatacttttggttcgagtaaacctcccagaacccaagggcgacatagctgctgagaccaaggatgatcggtgtgatagtagccgcgctgttccaagaatattgcctccctccgaaattaatgcccaagaggaagagcactcctccagttatgaagagaaagatgcctgcatagtcaagttcggcaagcagctgcatcttggtcttcccatcgtggcggtgtttcatcttgaagtcaggggggcggtagaagatccagaggaagataaaggcgacgacatgccacgtgaacatataccagtaagcacccctccaaccgatgtcgtggaaggcgatgaagcaatatgcgatggccgggctactaaacgctatagcgagggagatatcgaggagacctaaataggtatcacatgtaagtctctctaccctaaaaccaaccatggaacagcgagtggcacttaccaactcctaccatacggtgcttattaggtagcatttcttgaatgcaagcataggccatttcttggaatccggagcctattccgaaaagagttccgctcacgatcatcatatcgatactcttgccgttcgcaccaacgaggcaccctactatcgatatcgaagcacccgtaatcatgaaataccgacgaccgaagatatcggacaggcgaccactgatggaaacgatgatagagccacccagttgccaaacgatggtgatccaagagtagtaggggctcggcccaagctcctgatttatatacgacaacgtcgtcgatggaatcaacaggctcataacatacgcattgatttgaccggcaatagcctagaacgttgcagatcagcactccgttgctaggtaacttctttgcaggcctgtatgggcatacaatacaagcaagaatcgtctccttggtgagtttattgtggacatcattgagctcgcctggatcatgttccaatgctgtgttctcaagatgggaatggcttcctcgtggtgccttttctccgtcagactcggaaggaatatcctgagctggggtagaaccaccggagctgggatcaccagtcactctcatggtgttgtacttggctgttgccttcacgactgcttggttagctaatgagagcaaccacgcaagagactcacacacagcagccttctcgactattatactcctagagagctgcggggtgagatgtggaggacactatcaatgtatcgggcctggttcgaggtgcattctggggtaagactcatctgcacacaaatgaatctctccggatagggcgctccccaaatcgtctccatttccccacagtacagtgaatcgcggggtgccatcattgggtctaacgagatatcaaccgtaaaagcttctccattaggccttaccatccaaggctctcaacatctccgctatgaaaacccgcgggaaattcggatgggttatggggttctccaggttttggtcaaagacgggagtagaaaacgcgagtaagacccaagggtaagggtatatctggtcttgggttctgaaactggcttatcacttcggacaacgttttcctattgatctccggataagaggggcctcaggaccctgaatgttctgccattaaaacggccaaggccagaattaccaagctcattccgggccaacaatgtgtcacgttactgtcagcccagggaaaactggaaaatcgatttccggaacacctatttcgtcacatgccaccaccggtccctgaagcaacacagctataattagtctaacattccgattgactaagagagaagacttaatgagagcagccctttccagagaagaactcggttgtaggatcacaggtgctagctagttaatacttatcagttgcctagtagcattctgacttctaggaaacttcggtgagacccaaggaatgggttagacgaataagaagtgtaataaatggcagggagacctccacgaagtcgaatccctgaccatatcagtagccgtgtaaagtgtaataggttcgaaacagcatgaggaagagactcaatgaatacattgaatagattttagttaaaacagatgcattccgactggctggtgaataatagacatatgttgtagtctggcaaaccgcctgcctctatatcccgaacgccctcttttcgtatcatcgtttcgaaccagcctctctttctttgcttttatgtgtcccataacgccttgaactccggtaatgattcagatcgaccccggcaaagcaagtgagagtatcagtcgtggtcggttgtccagccgtccgagccaacatcccatgcctcgtctccctacagcagcacatacaacttattggatttccatatcctcggccgcagcgctttcacccgcatcggctttagcatcggtctcgacaacatctaaatccacccattagccactcagctcgaaccaaacccgtcccctggcaccatgacactcaaccaagtcgagctagagccaacttaccagtcatctcaacaataccctcagcgtccatcttccgcttaagcgcatatcccatcttcttctcaagcttcctcgccttcttgccgctcaacttggcccgcggcccgctgttgggcaggaggccaggtcgggcgccccgtgcgacgtccttcctcgagatcttgttcttgttctgctcggatatttgtctctgcgccttcttggccttcagcgaccgtgcggcggcacggatcttggacatgccgttggggttcttgacggacggcatcgtggcagtgtcaggataggaatatcgcgcggcgggtatagttttcgagataggggtcgtcgtcgatacttgttctctcgtgggaatattggaagctctttaactcgttgaaggtgaattggttattaaaacaccgttcttatcaagatgtgcttgcagaaaaaaaatatttggccccgctgctgctggtgcgggagatgccgaacctgcatggcggcatgtctccggatttagaccccactataaaattggatatccccatattcatattgaatggcatcgagcccaaactgcatgttgtcaggggtaatccggtatgtagttattatttggtttttagaagcctgaagaaataatgatggtgtaattcgatgatgccggagctcaagctggtgtcagtgaccaggcgagcagggctactgtggagagcacgagttgcgtagaagctggttttatcttgtatgtttacgctcacgaacatactcttctcagcttcatcaaaatagactcatacgaagtaatcaagattcctcccgccaagatatgtaaatctgatactttcacaagctccctaccttcgcctgactccacaatccaaaacaagatgatgtataaaaagaagaacccaatgatgcgttttacagaaagatgccggaattattcaatcttataacctcacgccaggggtctcaccgctacgacggagcattctttcaccctcatcaacttcgtcgtcgctcgtcagaccatccagctcaaattcctccgcatctgcaacctggccctcctcaaccgcacgaccattggcgtctgagtacccgtttgcgaagcccttggtatcgataggagggttggcaagacgatcataaaggtggatgagcatgtttacgaagaggaataccaagaaagcgagggagaagagaaccaagatgtaagagatgtggtccattggggaactggcaacgagcaacatctgctcttcctgggcacccatgaagaagaacccggccgaatataggagctgaagtatcgaaagttagcaaaagagtcggttgaaaagggaagtgaggcgttgaggtaaacttacgaagacagggatgtactggaaactgttgtaagcacggccatcatcggacagcgatggcttatccttgagaatgaaggcaatctcaatgatacgcgtcaagccggcacccatgagcgtgtatccaaacatggtatgtgttgctgcgcttaccatcagctcctgcggatgagccgacatgccgtatcctgtgatgaagatgacaaaaccaggaatgaagttacgcttggggtttccgtcgcggtccttgctcagccagatacccgcaagaccagcagcccaccaaatgatacccatcgaagtgtgctgccaatcgttcttgacccaggcagtgccccaacggtgctccgtgaatgtattgacacatccccaggccgcaatcatagcactgtcgaagaactcttgtgactgattacggcgtcggagccacatctgcccaacaagaagcatgatagtcaggatgataccatagccaataaaagcactgcccatgatgaaatgagcagcgcactggccgacgtgctcaccctggcagaatccgagcgccgtgatgccaccaaagatcatctgggtccaggataatactggcatcaacttgcctaggatcgagtggcaaggacggacaagcttcctaatcattccaaggatgcctcgctcccagtgcagcttcaagtataatcccaagacgacttggacagccaggatgatttgcaggatatgggcaaatatagagtgaacgttgttaccgatgaactcgcgaccgccgtgagcatgaccgaggaagaagcctgcaatagccaaagctgtgccgaatatttgcgtcggaacatgccatcgggacttggtcatctgaatacaagaagtcagcaataaattaagggcctccctgtctggtgccaaccaaagagcaacatcaagatacacatacaccaaatatcattccaatgggaaatacgacgccatacgcgatcatctggacgaagatatgaacccaaagaaccttgtcctaccacctagttagcgcagctgttttgtccatagagcaggacgacgtacgagtggctccagggagaccgtctgcccctcgggaatattactctcgcttccatgatgatcatgggccagagcaccttgtccaagaagtccaagtattaaaaacacgagggaacgacccttggaaggctcgaaccgcatcgcggagaccggtcgatagccaactgcttctgggaagaagaggcgcgagaaccgtatgaggaatatttcttgcgatcggtgggggattatcgggcaacagatctcgataacggaattcgatcgtcgaggtattcggcgttggtttcttgaagcaaagcaactgaatgcctgcgtatgaacgaggacggatagtaattgatgcgatggaatgggagaaaggaaaaggattaagtccagcaaaagagtgtggggatgggaatgttcagtcgaggaaggagcaattgagatccaggaatgctcttgcagggaattggagctcgatcgatttacggatacttcggccatacgacaaaaatgggcgttgtgattggcggcgtcgacgggtacggcggggctcatctgacccctgccgcgatgcattagttttagggggccctggcgaatcattccctccctattgccagctgtcaatctacataagcacttcctgaaagcaaacggctctcctgctctacccgcctactatatacctagtacttttttcttccagattgtcgagtattcttgcggaaagggggctctgctctggagtttctatttgaaacccatgccaaggcgaggccaacccaagtgcggaggacaagagggtggctttgctagacagggcagctcaaggagccacgcgttccggaataaaggggtatgttcgaccagccggagagaatatgccgaaagtccacgtccctccaaatgctataccattttttgtgtagccgtaacctcataatttttttcataaaagatcgactagagagttgcgatcgtgtcagcgccaagagagtagagtgtgtgtttcattcacgacaggcgtcctacaggccggcagaagggtcaaatataatactccattcattcacaatgaagcggggcggcatagcactgacggacatataatggcagtctggcatcacaacaccatggtttatcagtatacattttaactctacaaacattatagcgttctaagtacccggattgtactaggaaaggctttggcaaaagttgtgtttgtagcaaacagtggcgtgccacctccttacagcttcagcaatcatcaagccatcatatcatgtagtagtatgcaaattagtgattccacgatcttttgtatgctgtctcgccatgtatgaccaaaggagcaattcccctgcactcctggatcgaaagttgactcccaccctccaactttcgatcctcgttgcatcaaccatatgccaccaaaggggggccctgatatattcttgtctaaacggaacccatctaagctaaagtccagcgatagggacctttgatgcagctatgacttttaccatacttcagttttcgatggagctcatttcgagcgagcatgtgatactcatcggtacaggtgccgttctgacatggctcttctgccactggacgacgagacttcgcggaatctgggtgtggcaccacagcagaaccagcggcggtgtcactgctctcggcgaagtaaggagtgagcgacggagacgaaggcaaaggcggaggcggaggcggaggcgaagacgagtacaggtgcagggtggctggagcaccgaggatgcaataaactatcaaagcctcccttcgagcctggagactgcaagccaatctgaccgataaggggggttaagcgttctaggtgagaatgctcatcaagtgcagacacgcatgtatacctgtaggaagttagcttttttgtaggcagggatggttcaggattccatgatcatacccgacttgattggaaacatgcgacctgagttccaataattccagcttcctttgagatcaagtttgaagaattcaccatgtgtaactagagctactccaacttgatattgcttccctctttttccaagaactttcttgcgtccgcccaaagctcggcttccatgtctctttcgaccctggagccatggctattcaaccagccaacatcgaggtttccaacggcacccatcccattaggtttgagggatgcagttttgggaccactgctgccgggttcctgctttgctccagcagacaagttcacaataccagcttcttcgagagccatgatttggcgcttcatcttgacatcaacagcatgcagcgtgtccaagaaggagtcggttgcaccacgaaacgcggccttcttcgccgacgggtcttgctgcggaagcgttgcctgcgagtctggggagttgatggggatagtgagggcgttgagcgcggtggcagtgtggttcatgagatccacgatggatttatcaatggcattcagctggtggatgttctcctccacagtgaatggctcatggacccgggagtttccatcgtccatctggacatcctctggggaatccatcattggtttagagttgatgtttagattcaagggaacacttcgagagaaaggcgatggatggccttagcattcgagctagggtttggaggtggcataaaaatgtggagcgcatgtcgattgattgctgattgcctggaagaagggtaaagaccggctaatatttcgacatgcccagcaccaacgaggctgttagtgcgtcagcgccccgaccgtgaaggaggtacgtaccgtttccaagctcaagccttcacgaacctcgacagagcttccatcatcgcgcgacagaacttttagatgcatgactggcccatctatcctctctcagggccctattctgccatctcccactcttgctactcatttcgattgtgttcaatcccccctttttggtgattctgtattcctactgtccctgtagaagctctccagccacttgcctgtccgttgtttggcgcgggactgagcatggggcctcggcgttgatcgcctcgacacgcactctcgacacatttccatagagacgtcccaagcgcactgccactgtcatcatgtctggccagccgcccgcccctcctgtaccgccggctgccaactatgccgttcagccagcagcgtcgcctgtggctccccctccagcaggcgcacccgcagccgcgcagggaactggcacctcaatgtccaaccagaatctcaatcagatagtaagtggccttgaaggccttcatactcagcctttctctctcatctccctcctgccacacggccccctccaaactgcaccctctccaatgccctcacctcacacgcccctcctccgccctgtcacacgcatgcaatgccacatatctcttctccttcactctattcacctttcttttttttggtgctacatctctctacactcatatcgtttttcgcttcccaacccaagatcctcccccatcgtacttcccgcctctacatatcagtattcttcaagcataactgcttctcggcaccatgaggaatcccagttcacaatatgtgaacacggcgatgctaatggctagagaccgagataaagtaagatgttcagggagtgcatcacatagccttgctcataacatcatctagctctttattctgcaacctcttcggcgacagtggctgaccagttcacactttaggttacagattatctcttaaaaagaggattcaataggactgaagaggtcttcagacaagagtcgaagcatcttggtgcagatggaaagcctctgcagcagatggccaacatcggccccaaaaagtacggcatagcctttaataaccttaaagaatgggtagaaaacaacctggatatctataaggtgagaactgaaccccctctcaggaacgcccaaagctcgtctggctgacaccctacagtacgagctgtccaagttgttatggcccgtatttgtctattcttttatggagcttgtgactcaaggctatacggaagaggccaaggcgttcctcaagttgggggagtacttcaggcgttcccacgacgacgatcttaagacactcggcggtatcaccttgcctcagcacgtctctgataatgccactaccaagctctacaaggagaacaaataccggatcccgcttaatgaacatgcgcttagtgatctgtttaacttcatggagcgggaatcgcagaagggtggcccagtcattcgccagttgcttgttgagcattgcgaagtcgactccacaagccgaggtcctatcactccctacagttttgaagcagtctatcgcaagtctagaaacattgagctcgacgcagctgatatcaacgagggtattcctggagtcaagatcggtctagcaaatagggatgtgttagactcagcaactcccctaaccctgggtcccctgcccatggacccggacctaaaagaggatgtccgggccgagattgaggaagaggaggccaggcatcccccacagcctgggcgcagtatcttggaagaactggaccaaaagatcaagagagaagagagtgccgacgcccctaccagagccgaccttcccctgcccccgtcaagacctcgagacatcttgctcgaaatgtcgaagctccgtgagaacagagaccggttcaagatcgaaggtcggactggggggtcaggtgttccagtcagtgcgtgcatgttcacctttcataatacgttggggacgtaagtatcatgaggacctatatcttgattacgatgattaacaacgaaatagggttgcatccatggacttctcaaatgacggaacaatggcagccgcaggtaccactgaatcctatattcgcgtatggtcgctggacggaaaggccttgccgtcttctagcccccatgacaaggacgcaaagttcaacagccgcaaattgattgggcattctgccccagtatatgatgtgtctttttctgatgctgcctccggaccacctcagaagctcttcggcgatgagggcaccaagaactctgcaatggacccgcgcccaaagctccttctatcatgctccgcggacggccatcttcgactgtggtctctcgagtcatggacttgtctctgcctctataaatcacacgacggacccgtccataggtcagtgtggggtccccacggccactacttcttgagcggtggttatgacaaggcagttcgagtttggatgcaagaccacgcttcgccgcagcgcctcctcgtcggccacgacaccgccatatccgccatagcctggcatcctaacggattgtatgtattctcggcatccgacgagactgacaagtcaatccgtatgtggtcagtggtgacaggatcctgcgttcgcgtcctcagtggtcatgtcgactacatcagcgcccttgagtgtgcaccaaacggcaagattcttgcaagtgctgacgccgccggcaacatcatgttctgggacattgagaagggcacgcgtattaagcgctcaagaggccacggcaagggtggtatctggtctctgagcttcagcatggagtcaaatgtgcttgcctcgggaggccaggacggaacagttcgcatgtgggatgttgagctccccgcagacccccaaaaggtcgcccagcaagttggactggatgccgggacttcggctccggatgccgctggtgctaatgcggatgcagccaggccagccacgacgcagcaagcaagcgccgccccagcaactggcactcataagaagaagagtaaggaggttcaagtgacgccagatcagatcagctcattcccgaccaagaagacgccggtgatgaaagtgaagtttacacggatgaacttggttatcgttggaggttgctatgatcctgagcgctaggggccggacacagcagggtcaatcgatgttcctaggacctggaagagtcttctgtcccctgatgtgggctgtgctaaattcgaggaaccagtcaaggcttaattttagagcgaggagtcttgtcgtttgtttaaaatcccaacagtcaagattggagttatggcgagcggccggcttgatgagaagcacatgtataattcgtaggtatcttagggcagagacagcaagtgcaacctgaagaggcaggttaatccggcgtttcatagttaaataaatccattatgataatagtcttcaggctctttcgagtgaagcctggcctaggtattctgctagtctgtgcaagcatcacacgataagacaggggaggggaataagaacaccagtctattgaataaaatcaatggcatcaagaccccatcggcctctgcgcccatacagaccgttccatccggcatagcacagactccaaacgaagaaagcgaggcccggacaagctgcccgtcttggctccaggctgcaagctggtggtctggctcggcgctgtgctgctagacggtggggctggcggtggtggacggaagctgcgcaaccactgaactggaccagccactgacccgccgtcgtccgctgactggtctggctggtccactgacgttcgcggagccacatgccgcattacttctcacctcatcgaagctctcgcaactcccaggcagctgccgatcgaacgacccaatccaatccccaagcttccaacatctctcgcaatggatgttgaggaatcaccatgggctgatacaagccagggctccaagcccgacacccagcccgagctcaccaccgcggattcgacagctgccaccacgcctgcgagctcccagccagcctcaggagcggccccaagcccccgtccgactcgcggtccacgccgcctcgtggcccagcctacacgtctcgaggctgtagacgatcccctcggccctctcggcgccgccccctcaaccggtggcgatggcgctcctctcgaggaagaccggcccgcgcccccacagaaggagcaactggtgatgcggacgaccatgcctcagcctcagcagcagcagcagcagcccaggcgaccggccgatccgcatcgcctgtttgaggatgaggaggaggagttgagcgctgcgcagaggggccccagagcaccacctcccgtcgacgccgccaggccgagcaccgtccagagctcgacacagccgagcgtcagcgtggagcaggcagcgaagccaaccttccaaatctacgtcggcgacccggtcaagatcggtgacctgacgagctcgcacattgtctactcagtacggactagggtaaggacagaccgcatgatccagccgagcaatggggagagtcgcaagctaatcaagaggggattttacttgacagaccacgtcgaaggcctacaggcagcctgaattcgaggtcaagcgccggtaccgagacttcctgtggctctacaacacgctgcatgctaacaatcccgggttcgtcatcccgccgcctccggagaagcaggccgtcggccgcttcgacagcaactttgtcgagagccgtcgggcggcgctggagaggatgctgaacaagactgctgggcacccgaccctgcagcacgatgctgatctgaagctgttcctggagagcgagtcgttcaatgtcgacgtgaagcacaaggagaggcgggacgtcatccccaccgagagcaagagtgtcttcagctcgttcggtatcaacgtgggtggcggcaacaagtttgtcgagcaggatgactggttccatgatcgcaaggtgtacctcgatgcgcttgagaaccagctcaagggcctgttgaaggccatggagtccatggtcgctcaacgcaagatgatggccgaggcggccggcgacttctctgcctcgctgcatgcactctccacggtcgagctctcgccctcgctgtccggacccctcgatgctctctccgacctgcagctcaccatccgcgacgtatacgaccgccaggcgcagcaggacgttctgacctttggcgtcatcattgaggagtacatccgcctcattggctcggtcaagcaggctttcactcagcgccagaagggattccacgcctggcactcggccgagtcggagctgcagaagaagaaggcgaaccaggacaagctcctccggcagggcaagagtcagcaggaccggttgaaccagatcagcgccgaggtgggtgaggcagagcgcaaggtgcaccaggcgagactgctcttcgaggacatgggccggtcaatgcgggccgaactggatcggttcgagaaggagaaggtggaagacttcaagagcggtgtggagacgttccttgaaagcgcagtagaggcgcaaaaggaggtgagatcttgccaatgtttgcccccccctcattgattgaaccagcactgacaaacgagacagttgatcgagaagtgggagacgttcttaatgcagctggacgccgaggacgacgattccgtcttctacaagcctcccgtcttccaaacgaatcaggacaaggccccgggagacacggccattgaccgtgctcgggcacgcctccacgaggactcggattgaaggaggtcaggttcattcataccattgaacgatgtgaggccgggggctgctctacggcacacgaccgatggagatttggagaggcttgtcatttctttgttctcgtcaaaattcttatacactagcaagggagtcttttgttgttgaaatgttgtacatgttgtgtcaatatcctttcccgctcgactgtctattccccaatctgtagaaaaaactccagaccaattcttctcgaatccatgtctagtacactcattccgccaagatataaatccccctttccttttctccaaattatacaaggaaagcaacgtcttcgtattttgactccttatttcttcttggtgggagcagcatccttcaatgcgctggtatcctggttggcgtacgaagatatcagggagccgtagccatcctcagtgaggtcactgccgccctcgctaccatcctcgccgtcctgcttgccgtcaaaggcggtaccgaacctgccgcggaaggcggcgagcttgccggcctcgtcgagctcgacgttcctgagcgacttctccgagggctgccaggtcagggtgttgcgggtgtcctttgtggcgacgtagagcggctggggggaggtggtgcgggcgatgtaggaggagccgtcggagagctggacgagctgggtgaatgtgtagggtcggcgggggcgttggatgaatgtggcgtggcggacctggttctggaggcaggaccttgaggacgggcggaggagggtggtggttgttgtgcggagggttggcgtgagggccaggggggaggggatcttccccattgttgccggaagtctggggtactgagggtgacggattggattggaggttttgagatgtcagcgctcgtctaggtagggtgctgctttgcgccgggattgaatttcatataatcagatggccaaatgctcaaacctgaccgagatggttggacccatattgaaaagaattggggcgcggcgattgggtgggcttatcgataagaatattctctagctcggcgtcgacgaattcgagcagagtgcggctattcggatcaccagagtcctcgatatctacgattcctaggttcggttttgcaattggaaggctgttctgcgtccggttgcagaacagttgcgctccccaggacatgagataatgcagtgttgctcggcgatgcgagaagcgcccctgcgagcttggagacggtcggcttccagattcagcgatgcgacgacaggtttagacggggtcttgagatccaagacgaagggtgtgcgatggcaatctaatcttacgaataagcatatttcgagaccttgtgtagggtccctaaggtcgcccaggagctgtaaggaatcttgagtctgagcttctcctcgtcgacgactgaccatggagcgatagtttttcctatacgacccttccacagctcgtcgacagtgtattctgataaacctccgactcctacggcggccgtctctacttccgatcctctacccgaacagcttcgctccatcatgcgtcttctcacacatcccgtggtggtctgcactgcgcacgacggcacccaccctagaggcatgaccatgtcctccttcacatccctaacgctaactcccacgcccctcatcacatttaacgtcctggcgccgagccgtacgctggacgccatcacggaaagcggcgagttcaacatacacatcctagctggggacaaggacggggcggcggtcgcggagaacttcacacgaggcaacacggaccccagcgtcttccagagtctacagagcgcggcatccaaacaggggacaacaggtagcagctcggccgcccccgtgcttgtgggggatggcatactgtacgtgctacggtgccggctggcaggcgacgccgcgccaaacggggggctgatccgtgtcagagaccacattgtcgtggttgcggaggtggtggggacggtcccggggattgaggacaaggagtttgggctatcatattcggatcggagttttagaggggctggcgaggtgattgcccggcactgaggactgtgcttttgggctttggtgggtggtatgtatggggtatctagaattagactgtacaacaaacagcaacagtgtattatcatgtgtatacaatatagagacgtgtggtcgaatagaaccaagcagttgccgctcacgaaaagtctgaaaacacaggcttgaatcaggaggcggctaacaaagttgccgctggaaactctgacaggctttgtcgtgttagtgtcacacccaaaccgcttccagatctctgcgccctccaaatcaaaccaatcggctggcaaagggcaagaaagggagacgtataagggcaaactacgtggctggtggctaaccgttaggcagatggttggccttcaatgccgtctcactagacgccagcggctaggcacagctcttgtgttagcccacagattagcctggaggacgcccccaattgggaagtgtggtcccttgggtacgagtgcaagcatgttctagggaccagagccgcctatcattttcggccctggttcgcccccgagaataaaaaatgccggaagcctcgtcagcggcctagggaggggttaggccacgatcacgatgtgggcggatttggtggtgggaaagaaagcctgcatgagtcgcctcattgattcgttggcagacgttcctcagccttgccaacaaggtccatgcgtgggtacctggcccctccctcggtctgaggaaggtagcagggcgggttcgctgtgcaggggtgtggcgggcgtagcaaccgtttcaacaatagaggggtgaagaggatcacggcgggcaggttcgcgaagattctgcgtgcagctcaagcctatgtagggacggcagcgaggtccaagggcaggagtctggctcacaatgcccctggctacggcatggccatgtctttactgcaccgacgcagactggagaaggtggggttgtcgaggcacccgaaaaatgatgcgttctgaaagcttccatgtacctgccgacagacaattgtcgagaacaacagggtctctttcaggcggtggaaggctctagaagcctgcagccaatcagcgctgtgctccggcaggcaaccgcaccgtagaggcagtgcgcttaggcggcgttgttgctggggagaacaggcggtgctactagaacgtgcgtggaggggtcctttctgccgtagaatctgatggaatctcgagtcgaggggcccttctcttcctacaagtacttattttcccatccagctctctcgactctcttccttccctcctcatcctcatcctcactttttttcctccctccacactcaggatctatcatccttctatctgctcttgtgtgagcttgttttaattccccctccacctttttaacgaccaaggtaagcttgctcctactgcacacccatttacaccgcctgccccaaacgacgggttcctcagcctcgtccctccccaacttttttttcttcttctcaccacctcttctgcacgcgagcaaaaccaagctaactcagcaaccagactttgcgattcctttttgatacccgtcacaatggctgagactttcgagttccaggctgagatctctcagcttctctccctgatcatcaacaccgtctactccaacaaggaaatcttcctccgagaacttgtttccaatgcctctgatgctttggacaagatccgctacaaggctctgagcgacccctcccagctcgagtctggcaaggacctccgcattgacatcatccccgaccttgagaacaagaccctcaccatccgtgataccggtattggtatgaccaaggctgtaagtctgacccattgtggatggcccatgcaagtctatagcaatagctaacaagtacatcacaggacctcgtcaacaaccttggtaccattgcccgttccggcaccaagcagttcatggaggctctgactgctggcgccgatgtctccatgattggacagttcggtgttggtttctactctgcctacctcgttgccgaccaggttcgcgtcatctccaagcacaacgatgacgaccagtacatctgggagtccagcgctggtggtaccttcaacatcaccgccgacactgagggtgagcccctcggtcgtggtactgccatcatcctccacctcaaggaggagcagctcgactacctgaaggaggccaagatcaaggaggtcatcaagaagcactccgagttcatctcctaccccatctacctccacgtcaagaaggagaccgagaaggaggtccccgatgaggatgctgagatcgaggaggtcaccgaggagggtgacgagaagaagccccgcgtcgaggaggtcgacgacgaggaagaggagaaggagaagaagcccaagaccaagaaggtcaaggagaccaagatcgaggaggaggagctcaacaagcagaagcccatctggactcgcaacccccaggacatcacccaggaggagtatgcctccttctacaagtctctctccaacgactgggaggaccacctcgctgtcaagcacttctccgttgagggtcagctcgagttccgtgccatcctcttcgttcccaagcgtgctcccttcgacctgttcgagactaagaagaccaagaacaacatcaagctctacgtccgccgtgtcttcatcactgatgacgctactgacctcatccctgagtggctcggcttcgtcaagggtgttgtcgactctgaggatcttcccctcaacctgtcccgtgagactctccagcagaacaagatcatgaaggtcatcaagaagaacatcgtcaagaagtctcttgagctcttccaggagatcgccgaggacaaggagcagttcgacaagttctacagcgccttctccaagaacctcaagctcggtatccacgaggacacccagaaccgccagatcctggccaagctcctccgcttcaactccaccaagtctggcgatgagctcacctccctccaggactacgtcactcgcatgcccgagcaccagaacaacatgtactacatcactggcgagtccatcaaggccgtcgtcaagtctcccttccttgacaccctcaagaacaagggcttcgaggttctgttccttgttgaccccattgacgagtacgccatgacccagctcaaggagttcgagggcaagaagcttgttgatatcaccaaggacttcgagctcgaggagaccgatgaggagaagaaggctcgtgaggccgaggagaaggagtacgaggccctcgctaagagcctcaagaacgtcctcggcgagaaggtcgagaaggtcgtcgtctccgacaagctcggcggctccccttgcgccatccgtaccggccagttcggttggtccgccaacatggagcgtatcatgaaggcccaggccctccgtgacacctccatgtccagctacatgtcctccaagaagacctttgagatctctcccaagtcttccatcatccaggagctcaagaagaaggttgagtccgacggcgagaacgaccgcaccgtcaagtccattgtccagctcctcttcgagacttctcttctcgtctctggcttcaccattgacgagccctcaggcttcgctgagcgcatccacaagctcgtccagctcggtctgaacattgaggaggacgatgccgctcctgagactgaggtcgccaccgagacccccgctgctgccaccggcgacagcgccatggaggaggtcgactaaacggctcaagcccagaaggttatgaaacctgaaaagttctgaggagtttggtagggttggttttaatgtgctcatggtattggacgtctcctaggtttttgcgtttttttgtaatgacaatcatcacacggatttaggtgtgaatcataatcccacgaccccacgccatcaatgaatggccggttgcggggtgtactctagctagctcatcacaaaaagtagatgaagtagaatgcgataaatggaaatggcatagaatcagttatgctgtctacatcaaacctcttgatccttgaatatgtggaaataagtcttgccctcatgtgaatgtacgcacatggtagaccctcaattacgtatctgaaagtatcaaataacacatgcaccaggcgaacaaattggtatagctacagctgaaaatagtagttccaatacatgcatataatatacattatatacgcaaccaaaggctgaattggcatgactatcaaataagttaactggactttagcgaaacaagtagcctcgaggggggctgcctcccaaaacgccaattgaacgcccccgtcgccagagatgacgagatagatacaggagaagagaaatgcctcgcggtagcaagcagcgattttgctctgaagaagaagaagaagggggtatctactcatagcaagctagataaaacagaaagaagagagaaagaaaaagaaaaaggaatagacgtgaggagaaagagctaggtgtgtactggtttttcccacgtttgatgtggggttggtataatgtctatattggcgcgcgggcgagcttgaaaatcaacatgagatgggaaaattgtgaagaagaggaagggaatgagggtggtttagagtttccaagggaaggggggggttggactggttagatgaggacgtagagagcgcatatctggcaaaggtcagtataagaagagcagataggaggaaaaagaggggatgaaacataccaggctgagcccgaggatcatggagcaccagaagaagacgttgttgagcgtcttgcggccgcggacccagcgggtgcgctgcatcatgaagacgggcagctggagcatctggcagaagaagccgtagccgcggatcttcttggtgatgcaagccatgacgatctcgtggccgatggcggagatgaggaaggtgatgagggtggcgtaggacctcccgatgtgagggctggcggcggagtagacgtggcggcggaggaaggagtagacggggacgttccactcgcgagaaaactccatccagtcggtcgagttccaccagtcggagtagaagtgacgatcgccgaaccgcgtgatctcggcaaatgcgcccaggacgtactcgaagatgacgaggaagacgaggaggaaggtgagggtgaaggggaacagaagccaggagatggactcgaggaagatcaggatcccctccgacgcagatgtcgcagcctcgaggcgggtagaggcatcatcaagaataggcagaatgaactcctccgaagttatcgtgagcaggaagatgcagccaaaagtggcgatgatcttggagatgagcgaggtccagttgatatgagtggttcgcgggtactcgagttcgtagcagagagtgggacacaggagatagtcgaagtagttggtcagggtgacattgcgtgggtaggtgacgctgcccatgggagacgtgagctcgcgggcaaggtcctcgcgcagggcttgtacctcgtctgcactctcatctgtgtcctctggctggcggttcttcggattcttagccttagtgcccttgaccagaagcacgccctctgggttctcagcgctggggtacaggtaagctgggcgacgatctgccgtggaggggctgtccagttcgcgcaatcgcttctcggtctcggagagatggcccatgtagaaggcgtacgagtgcatcttcatgaggaggaccatggtgtgcagcagcaggaagacctgcgccgtccacgtccactctaacaggaaaggggtggcgacccagagactgaaccagagggtctggtagatgctctgcaacacgacaccccctctcctccaagtccatatactattggcgctactccacctagccagaaggtggatggggatgctgaccatcgtgctggcaaccatgaggaggtcgacgatggccagatgccagagcttcaccgtgaacagcgtccagatggacgtgcgcaagggaaagccggtatccttggtattgcgcagcatggtggtgatgcccatgatggccaggccgatccagaacaggttgaagaaaccgtggaagtcgcggtagtcagactcggggtcgaaatgggacactcggctcgcgtactcaatggtagggaagatacgcctgcgctgctcggcgcgagcctgcttccgcgcagacgagaggtgtttctcggacgggggcgcattgtctggtaccggcgtcgatcgaccactggggaggggaaggagttgtcagcatttccacgtacaggcaacatcacagcaagctacgtagggtcttcttcttacctagagcgaccgctcagggtatcgtgatcagagggcgcgaggtgggcaggcttcccctcctgcccctcgtttgacgccatccacgccaggtctctgacctgggcatgttgcggtttgcgcggacggggccgcaggacgtgatcgtcattgtgattgttctgggaggagctcgtcgtttctgcggcggagcccatggttgctggaggaggagaccagcccaggcgacgaagacgacaacggcgatgggagtgacgaagggacgggcgagttggtgaggagcctggcctctggatggtctattcgatgcgacgtgcgctctggatgctacctatgtgatgggaacagaaacatgcaggtccggaagtcaattgatggtggtggggagagaggaaagacgatggagagcttcggccaaccagtggctcggcaccgtctcaggtcaagttgagttaagcgtgcgggcggcgtcgtcgatgatgtggatgagtcgtagtgcggctgtatgtcgacgtggatggaagggagttggaagctcgggcagagtcaacaagagctttgtcaaagatgggccagaattaaagtcagaccaacggggcgacagtccaaggtcagtctggttttgtaagatggggaatcggggacagttctggaaaggccttctcagacagatcccgtcgcagccggagattctgaccaaaggccacaacgtcgaaaaaagacagttgaggcgagatgcggcgctctacgtcactgtttccagggctgcagcagaaccatcagggggccatgatttcatctggccggctggagccaggcctggggggcgataagtgggcgcgacaggcctataattacgggggccagccactagcgatgccttatgcaatagggattggatggcgtagggcagctgcatgagtccgtgtccgaaccgcagtctcaatcccaacgacctgatacaccgtacttacgcgtacctttaatattatctgtaagtactaattcagaatccagagggccacagtgacgaaccgcggctccaatgcgagtttacgagagctcgcttcccgagcgcggtgctgtacgagatcaccgatccatccatcaccttccacagggcttagtcgtcttctccccccctccttcggcaacatagcacaggctccatgtcggcctcggtttccctgcctgcctaaaaacccgaagcccgtcctgactatcgtaccgcctctcccgaagaggccagccaataccgctcgtagccacggccgcggtccaggctacccattattaacgttgacgacgacattgcgcaacgtccggcaacacatggcttcaccctaagagcgatcatcagccactgtggccacacaacggccaaggttcccccttctagaaaatagagggcaccaaccagctgttgcatcgcactcgatccggggcttggctgagtccattgactacctaatatttcatctcaatgcttttttattggctgcttttatttccagtgtacgagtacagtatccccagtgggtgcctgtctctgcctaagtaatacatgaacggggacgtagaagcctccgatgctgcgaaacaatgcgctacttcatgctccttcgcctacacccacagataataatgtaattccagaacccagtatcttgacccgcgtatagatcccgaccaacaaagaaacgacaaaacaagatgtgactccgctttagtatatgctttaccatgtaggttacagtccctttgcagcccttccaaaatacgaagatggcgccgcacatggatattggttgtctattggttgtgtgtgtgtgtgcagcatcacgcgacctgcacacaagacaccccatcccatcaccaccggctccttcccagaggcgacggtgtcaacgaccgcctgccgccgtcgccgggcaccatgatgtcccggttgtaccggctgtgcaccgtaatgttccacggcatgtgaagccaccactgcccgtccagatgctccaggtgtccccgccaccactgagcgtccttgccccctatgaagagcaggtagctgttctgctccttgtgcagcctgtccgtcagccgcgccagcgtgtcctcgacgttgcgccgccgcttctcgttgcgctggttgtcctcggggtatgcctgggtcccggggtccagcacgtcgtcgatgccgcggatcaccagcagtttctgcctcagcgacctcaccgactcgcggaccatcgacgacgggaggtagcggctcccgtgcagcctggtgcgcttctcgcggtacggcagcccgtccagcatcatgtttggcttgtccaggtcctttgccctgtagaagtaaacctcatccacgaggttcgtagccagccacatgctgatcatctggtcaatcgtggtttccatcttggcgtccgagcgctgtaggtcgctcgcgtacacgacgcggaatgtcgtgagcttgtactcgagctccaggaggtgcagcttcatcctgatcggctcgtccatcggcgctatcaggttatcacccaggagcaccgctggcggcttccatttcaccctggacgagcttgagttagacgagtcttgggactggtctgataacgacgggctgcggtcgcgtgacgcatggttgatgtgccgcgactccctagtgtagtttacgcagatgaagaaatccttgtatcttcttcccgtcttgtcagcgtactttctccggatggcttccctccccctgtgggccgcgacgtggaagtcggcctggttcaccaacagctcgttatagaacgtctcgaggtacgtggacacggtctgccagtggacgtaataccacatggcagacgcgttcgagatgccgtgcctcaggaacgtctgcgcaaggttcgtgcctgactcatggcggttgtacgccgacaggcaagagttcaacactacgttctcaaccttgtacctagccagcacctcggcaatcgagtccgctttagctagacaagtcccgggcagattatagggctgtcctacggtttcgtcatgctttttggcgaacagcagccagggaaccattctaccatgcctacaaaagcgttagttcctctagacaataaaagaaacgagggggggggagaagccaagacatcccagcttctccctcactcgggtgtggggctggaacatactcatcttcctgcacgataccatgcagatcaaagtgcacaatgtggaagaacacatcctgccgcgacctggtcctcagatgctgctccagctcctcacgactccccggccgcaccacctcgagaagcatcctgcccttccccttggtcctcagcttcttctgcacggtcatgagggggtactgcgccaggtccggctccgggtccctgtcggcgccgctgagtgtgaaatcccgggcgacgaccagcagcaccttgaccaagtagccgctcctgaccgaggagagctcctgcggcactcgagattgctgagtgccgccactgccgcccggcacgaagttggcgacgcgagtgatgcgcatgcagggcttgtccattgactcgaggagctcccatgccaggcattggatcccgtgggcattctccgacggcctcctggaggagtgatcctcgacgacgaaaatgtggtacttggcaaccccagaattccgcagctcgagcttcttatccagctgagcaaacagattctcggtatagtcgtcgatcttgagctcggctccctgcacatccagaggtgccgcctcatcctcggccgtcaagagcaagctaggcttctcagagtggcggaggtatggctccaagatggacttgtactcgtcctcggtgaaggggtcattgagctcgaactcgtgggggcttcggttgttgatcgtgacggacagcatccacgagcggtgggtggcaccgttggccgccggctgggctgcggcatggttgttgttggtgccattcgcagaaacggagccctggtgctgatgttggtgtgccgtccgaggggattgcgatcgtgtacggatcacaaccaccgcatccatctcctgggcccgattcctgactgtgtcgtcgtgtccattgacagcatgttccgggtgtcgtgtgcctcctctcgccgccttcgctgggggcactcgcccgttgctgcctccaccgctcttgggcgggcgtcttcacgaatggttaaaatagaggtatgtcaagaatcgattcaaattaccgagctgtcttatgtccagctgttcagagagatcaatttcgctcggtagaggactacgaaaaaaagaacacatgcatgggaagcggaggaaattaagctgggatgtaacatgacacaatcgatggagcctcgttggaaaccaaacggggttggaggcactaggaacacatagcgcacccgccccaaagcgccacaaaggtgagggaaggtgctagcggaagcctcaatggacagacacgctaacagaccccaagactcatggccgtcgacgatgctagacagctgggcgtaggtaggagacctcgcacaagcaacgacgccgggagctacacagcagaccaagcacaagtcttcgtgatggctctctctaggcgcataagaataggtagatatggggtggcggcggctgtactgtgccgtgcgggctgatctactggcctctagcatcgggcggcaaagacgggagcgtcaggcgactaacaactgcccgcttccccctttcccaaatgggtgtatttcagcgctgaggaaacaccactaattcgaacaaacatcgaacttaaactattggattggacgacgccagcacaggcttaagatgacttccctcagccggtcctcgaagtcgactgactaactagcagcagtcattcagcacttctctctacctaacacatgtttcttttttccgcatgggcccctgcgcccgtctaggcaggtcacagccgtttcacggtagagactttataataagcaagtaccggtgggtactgaatggtagcattcgaggtgtgtacggatgtgatgccctctcactacaactacacgcacacgatatgattgcctaacacatcgatgcaggcgacctctcctcccgccctatattgcacatccatgcatcctacacgtatacgaactgcccctatccctattccctagacaagggtccatctgtactccgtagcatcgcatctgccttgcttcccgcccggatatccttcccctatgcagggcgaacacacacccatccaccaggcatgattggaccagcagccagtgtaagcaagccgcgccctttcagctccgaacaccaagctgcctaaagcaaacctatgcgccgccgtcacacgaaggccgggctgactgcctgcacgcaacattccctccgggctcagcttgcacacagccccatgggacaacgcccggcattgtcaccctccacgtaaacgaatccagacctcgatgatgtgcaggcccatgcgcaaagccttctccctcgtagcaccgcagcctgtgaactgttagaacgcccgagtgacacgtatgggtttccctttggttcgccacgagacgaacaggcggaccattgactcataaacgtcattcctacattcaaatcaaccgggtagcacataggcgaggcagacgataagccacgaacatgtaatcaaatcacacacagacacagacacaaaagttattgcaaaggtggataacacagaaaaattggtgtgcagatcccccatatcagggggacagcaaaagatgatgtttacattcatgctatcgtatgcaaaagcggcaagacggcctctacgccgtctcgcgggctgatgcgctctgtggccaaccccatttctcatgatgggggtttcgtactggcggaaaagagcgtttggtatccaggaccaagacaaaaaagagtagtattataaaaaaaaaagaggtaataaacgcctattccgcatgccgtcatcagtgaatctcatctcactgcgggccatgccatgctccaatccttgtgagactccggtcaggctgtgacctgctcatccttgcccagaaaacaaaaaaaggaaataggaaaatatgtgagaacgagagatggaggaaagcgaatgtgccgaaagacttcataagatttgcaatatgagggtgagagaatatgatggagatgaaacaagacaccatatgcgtagacatgcttgaccgtaaatcttcgagataggtgcaggccaatcatgccgtcggaactccgtatgtatttgcaagaagacatcgtttcgaatgatgtgggaagggaaagaatcgagagaaaagacaaccccaacaagaaacaggtggtaatgtgtgtcccatcttgagcccaggaagcagacagtgggcaaagggaatatttgttcaatcaagtacacgctatgcatttgtagggcactgcttgggtcacaccagccgtaccgcaggtaaaaggaaagggaagacaaagacgcgagaaggcgacatggtaggagcaacacggttgcctagacattctatgcctgaaccgggtattcgccgccatatgccgcggaggggtagctgctgaaagcaatatcatcaactccgtagctctttgaggtcttcaccctgtcgtagtaagagccgccgccgccatacccagagtcccttgcatgcatcgatggacgcgtggggtgatcaaactctggatagtatgggctggtgctgaacgagttggtaggctcgtagtcagcgcggttggcgaaggagtatgaggtgctgtacagatgggaccgtccgccatcgacatgatagcggaattcggacggtccctcgggggaccgatgcttcttgctgctccggtgcttgcgctctcgatgcctgcggtcgtggtcgtgatcctcctcagaatcagacaccacctcgtccagcgttggctgtgcgtggtgcttggacctgtgtcggccacgatcacttcgaggcgactcgccgccatcaccatagttggcgaaagtcttagatctaccaacagggatgggccggcttgaagatgtcaagggcaccgaatttgttctgttcagagttgggggcgaagtggcatactttggcggtgaggcactgatgtgtacttcgtcctcctcctcatcaagctgctcccgggatgcctttcggcgagatttctccttgtagccttctggggaggtacggcgagccgaagaacgacgaatatcatcgtctttgggaggggaatgggggccgcttcgcggaggcgggggtgtaggggcagatggcttctctgaatagtacacagggtcttctctcctggccatgcggatgtactcttgagcaaaggaccgcgcgtgcgacccgtcagggaatcgagggctgggctcatcacggtgcactgaccgatcacgctcccgctcgcgcttctcctcgtgcttcttgcttgacgacttcttcttctccggcttggggatgtactcctcttcgtgctcaacgaaaatgtcctcggcatacctctcctgtcgcttctcctcggagccctttttgatgtccttggacttggccttctcgcgttccttcttctccttcttctccttcttctgggcacgtctcagctcctcctcttctctctccttcttctcacgtcttcggcgatccttttctcgctgttccttctccttctctcgctctctctcccgctcacgctcccgctcagcttcacgcttcgagggcttctcagtgtatgatgcctcccgcttcgacgagtggcgaggctcgtggtcgtagtacgaccgagaccgagactgggatctgctccgcttctcctcgtcatacccggggggcgagtacgtggtgaacacccggacatttggggatccagaggccggcttgtgggatgaccgagattcagaaaccttgatgtcgtactttcggggggcggaggagttggccttgttctgcagctgtgccttgagctcggccagtcggagcgagtcatcgtagcggcgtcgttccttttcattggagaggacctcgtaggcggtctgaaccttttggaattcgtcctgcttctcggccttgagggtcgggtcctggaccttatccgggtggcattttagaacaagcttcctatgggcagatcggatctcgggaatttgggcatccttggcaacaccaagaatcgcgtaatggtccggaagtgggctcatcgtgctgtttgtaggatatagggggcctggattgcatcaagaatagacgggtaaactttgtcggccagcgaaaagaacggtctctgtgtgtatcgtgaatgaatagcttcgctgggttccaggctcttcaaggcaatgagaaaaaaaaaaatcaaaagggggactgggtatggaggggtgcgggaaggttcctagtgcaaagtataatattattgatggtgtcgaaccggatcgagagttggtatcaaggctgtggcttgttgcacggaaggggttgggagcaggcggattcgtagaccgtatttaaaggcacgaaaggcttccagggaatgatcaggttgggaaaggtgatttagtcaacgttggcagactgaaaagattatcagtccgtttgttcgatgacaatgtgtgaatgatagattggtgtagttggagcttagaggtttggctggggcgttctgttatgaaagacctggaggtccgtggaaacagaaggacaaggagtgggagggaagagcctactaatgatgaggtcacgggcttgctgggggatcccttgtgtcttccctaggggacaagcgtagatagaactggatgggggacagccgatcagaccgtagaaagaggggggcaaaaaggtgggctggagtgggtagatgacagggagcttctcagaatgaacgagtcgtgagaacgctcgctactatgcacgccgctgttggtgtggaatcggggccacgcttggctccctctaatggatggtggggaggtctttcgtgccaaagcataggtggaggaccggcaatagtatcgcagttgcgtgaataatggcaccaccgaattgctagcagacggatcgcccgcgaggaagctggatccagcaagcctcggactgggcgaaagggcgagtgcagaataccgtctgtgacgtggggaggattggtcagggactgctgatcgtgtctgatcgtttcacctttctctgtacttcgacggcggcacaaggcctttgtaataagctacaaggcaatgaatggaatctgcgggagatggaagggatgagtgcgtttctgggttgcatgtgggcaccgtgtgatacgtagcatgtagctgtggcgtttacggtacattccgtctttgtgactgtacatccaaagcaatgcattacccccgcacagagcaagtagccggcccccgtccaagtgtatccaggggctcccaggtccacgagggtacggacggacaaggacgggacctgaacgggccacttagatttcgaaccatcggccttttaacactgtgccaagtaagtacccaagtacctcgcgacagcttacaagtgcaggtttaactgaatgacccaaaacggcagtagatggaaagcgaatgcctcctccagccagccagatccaaagactcacagagggctgacacgactttgaccgaacacgcggctcgccaggccgggggaggcgaagccaagatgctcggtccgcatagcctcaccaggaattgaaacaatcacgtatacacatgcccccaatgcagaccgaaacgagcgaggcctgtctctggcgaggtcaaccgctggtaggtattcgtctgcctggacctggagcaaaataagaggtggccagggcctcccgccacagggagctagtggcggatcccagataggcctggtctggtctcgtccggaaccttagcagccccctaaaggttccctgctatcgagtggtgcacacgactcccggacggccgacgcagtgcctagactaggcccgttagggtgctacagtggccaccaccaccccagccgagtcaatcccccaggaacgttttggcgctctgctcgcttgagggcagtggtggcgggcatctgacttttgcacggtccggaagcttggtgagtaatctagatgccactggacgggactactcctggcggacgcttatctgcaatcgtctcgatgagccgatgctcatgatgactacaaggagagtcattttccgaggtcatgctcgcacaagcgcgcgtcatgacttagcacgaggaaaacctgctggctgagccatccagctagacccaagtggaatgccagagaaggcgcaagaacccttggactcctccatcaccttggcctgttagtcaacatgatccatccaattgcccaggcgacggacctcctgttcccacaaggaaatgcagaatgctgccgtcgaccaaacagaggctcacactaaagctgcaccttctggctaccttcgctgaaaggagctacaagggagcagcaggaggaggggcggtgaatggttgttgcgtcaatggtatcagctccggcggcacactccacagaccagctccagcactcaggtgacagctgcttgtggggagacatgagaggtgatgtttcgggcggcgcaggcaagaccgctgtggaaatggccactctctcactatggatgcgcaatccggactcttgtgcagaaaccggttgccgtattgcctcacaattgcagattgtgagctggctgatagaccgagacaaagcaagaaacctacacatctcatcccttgggagtcatgtcaaaccggtattgggggagcctgagcaaatggcggtggactttagtgcatccgcccggcaggtacctccctactaaatttagcagtgggggtacataaggtacctaccgaagaccacctccgcccatcagttaacgtaacctcctcaacaacacgaggtttctgaatggccgcatggccccaatcgcaataccgagcaagagagacaatccgtatcttcctgacttacactgccttgttgatccaagccatgtctccatgatggcaaggttgccccatccagagtctgtactatcattagcatcgccagtctatctggtactaccaccgggctggatctatggcgcttacagcgtctccattgtcagcatacgccatgctaaacctcccccaaatggctgctcccgtaatgggcgtaaaacgttaaattccccataccgttacgccttgagggcatcgcgtggcagggcatacttcacgtaggagcaacgaaggagtaaccaacccgacgtatacgtgcatacgctcagccaatgtaaacgaacgtagcagccacctacgtgattactactggatagtccgtctcgcgtaggtctatcgcctgggcttgctgtcggctgagcggtttctacaactggaatggaaaggattcgaaactgatatgcagccaacccccgctttctcgcccgtttcagtccattcgaggtgaccccgggatgggagcttcggcattatctgctatccagctgcatccaagcggcgcgcgttgcatgatagagccaaggccctatccagtgtcgccagagcttcctcctgcaggaccaattggtgaccagtaattcgtccggagctcctctgctgtatcatgtatccaagtacccccaaatgctggttttggcgagcgctcgacatatctcattcctggaacagacagtgatccgttatccaaaagtaccaccccatgcaaagtcgcttcaggcgcaaaatcgattggtcgattgaggccgttgagagatgggataggtatcatccatttgcatgcaataccggcagtctgacctcccgaggcggcccaggtcgtaagtttctcccccccccttccctccctccctcccttccaaggaagcttactcgaagagaggcccggcccttggcttcacacgaccgaccgaccggcttggacagtctggttagccccaagctaaagtaccacgcgatgctgccgttagccaacaggggaattcgaccccacgccaccctgatcaccaaccaacgggccaacccaagcatcacatcagccgccgcgaccgccaggtcgccgaatggggacatgtgtgcacccacagcgcgcaagactcccaaaaagagggtgtgggtgggcatccgcatatgtcgtgagcctatcgtgagctgcgacatggccttgtctgagtgggcttccctcttccactattggacctgcagcaacgcgcatggtcgatgatgcgcagccagtcacgttggcgatatctgcacggcaccaatcacgcaggggggccattcgagccggccaggtccacctctctatcccattctgcgaataaaggcccagcaggatgagggggcagacggtgttgctggagggatgaacctgttcagcatcatgcttcacgatgggagatggaggggaggtcacagtcgatacgaaaccgtcgagggtggatgttagtagatctagcgtgtgtaaccaacagctgccttgggtccccgtaagctcagattgcccgtatctgacacctgacatgcacaggagaagtctagggctagcgagtgtggttacgtcctgccctcttgcagggtctgacaatcaacgaggccggagagtctcattggatgcaaatgtggccctcccaaggaatatgctctttgtgggtatgatcgagctctcattggagaagggctttctagccagtggtagccccgagctcctgcgaagctgtgactggatgtttccttgtgctgcatccttcttttttcttttttttttttgcacatgctgctgcgagggtgaagaggaggtggtgggagatggtgggggtgtggccatgatccaagcatcgagagtcccaaggctctcccgctccagggatggaccaagattccaagatccagtatcctagacattaaaatgtcggagaaatagacggctcggcaatgcaaatgggcatttggcggtcaggtcagtaagggatagaccgcggtttggggatgggccctgatcaccatcgttaccagagacaataagcaggatctacattgatgcggcagttagagtgctgggtacagaagaaaagtgttggaaagctgccgcggtggtggcgggaggatcggctggtttccgaggctccaggctgggttacagggtacggagtacattaatacacaaaaactacggcgagttggatgttgctttcgctgacgggtggcgcattgaacacggacgctgtatcaccaaccgctgcaactcaacgtgcaaatgcgaggccagcaaatgcgcaggcgggacgaacaccatcacatcacagccagccaggtgactgaccaacaccagacggtgtggcctgacggacgagaactaggaaccttccggaaaagggtgctggaaaatttgaggcttctctggacgggctcttctggctgctggatgtcaccctgcgtcggccaacaccggtgtctggactggaggaacgtggcagcgaatccgcacgtcttggatgacgggcctaggtcgattgcggatggctctcagcggctagcggcgagatgagagacaatggacggggagagaacaaaggcgccggccactcagcttcgacgagctgcacactttttccatttgagaatgcaagccaccaagcctgccctgcaacctggaagcatccggctggctgctgttggtgtgcagctgctgtcttacaactggcgggcaaccacagcgcttgcaggcccggtcgtccaatccagacgatgtgattcagaccatggggtgtgataaggcggctctcgccattcagatgatcacgaagatctccagattggctgacggtcaatgccgtggttgatgcggccactttctgctcaaaatgcacttctccgcgctgtgctgactggaatacgactgcacagcgaaaaccgagcccaaaagaggaacacaccagtgtgccagcggctgatgcagttctacgagtaagacccaagaaacaaacagtaggcaaggggagaagaaacaaaaaatcagagcgatccattactcaattctcagactactcacgcgcatgtcccatacacctacaaaacacactgcattaacaagacaagaatcgagcggatcggcgatcgtctagggtagtagcattgatcaggtgcacaggacaagaaaattcgaaagcaatgcttccaccacgaggtggaaacccaacccaatagcaagacatgttagctccaattgacccgtccaagattgtccaggatatccttgatcaccagtagcggctccaacggtgcggtgacctgtccctcggagcatgttccacgttttttctccctcccacaacctcgagaccagcttcctcgtcatgactcttttggaattgggttagttgggcagcgtcagacctcccaccttgggacccggcagagggctacagcacaccaccatctgcgagcctcgacgtgcccatcacgcgagtccatgggctcggggagcaaagtgcaatgttagacagacgtgtgcatctccttgggtatcaaaatcgataattcgccagcaacttgctgccctgcgaaccttgcaagggatgggaattttccgtcaacagtgtgtccccaaatgcgcatgccggcccaagaaccagctcgatcactcctcccagacgggcaggtcgaggtccaccacgatcggtttgttgaactgcttcccacccacatgggggtatctgctcttcatgatcgctgcgttgacgatgcacgtctcctccctgcccatccgcccacccagcgcctcccagtcgcagcgcgaggactgcgggtcgtcgccgcccagcccgatcgtgccacggcagacttgggcatcaacggcgacgtcagagccgagcgtgaccgggccagcgacagtagtggcagctgtcgtcgtcgatgtggaggtgcggccacggtattcgcctcgagagccgtcgttggcgagcgacggggtcagcctgcgcccggtcagatctacgaggctgatcttgctgctctccatgcctggcgccggatcggtccatctggccactgatcgctctgcgaaggcgacgttccgggacgtgaggtcccatgtcacgcgctcggcacctcgaccgtcatggatgtggccacagacggccagccgaggtctcacgcgccagagagctcgtcggagcgcctcgcagccagtagctcggcgctcatcagtctcatcgcagtgcgtgcgggcgggtgtatgtgtcacgacgacgtcagcgtcgagggggatatcatcccagatacgtgggaggtcggaataggtcgacggcgatataggcgcattatagtagaacgcccagaggccatgacgcggagagtatggcgacccaaagaccttgagctgggtacgggggccatctggggaggtgaggcggattatttgagatgtgtggttgaggtaggtgatgcttggggaggatgcgagcagagagagacagtcctcatgcgactgagggttctggttgtgaaagtagaggccatgttcagcgtagaacgcctcatctagtgtgatgtcgtggttccctggagcgtagtcgtattgttaattctccaacggccatatgagatgtaagtgagtaggcatcaacatggatattacctgcgataactatcttggcctcaaacttggcttcctccaaccacttgacagcacgagagagctacgtaggtcagtcagctccagaaccaaccagttgcaaaatgtgattcgcttgaaatatacctctgaatagctgccctggttcgtaatgtcgcccgcgtgaataaggatatccccctttggaagcttcacagtgcagttgtgagtatctgagatgcagacgatgcgagtgcgccggagcttggtgttgtggtgttggtctaccatgagtggacgtagagaatgttgagctcctaaaatacagtgttggcggccgattgggttcccaggtccttgtaattggaatgatatatcgtgatgagggttttaggtatctgacatgaagtccgactgactcaccgacgatcaccacttcttgccttggtctgcctggtgcgaggtcgaagtgcgcctggtgctgcttttagcggcaacctaccaatcgccagtctcacctacctcgaatttggataagggtaatcaacaaggcaaacgtagagttaggttgatagcttgggcaacttgaatcccagccttttaatctagtagccttattaacagccctattaattgaagaatgagctgttgtatcagattcccttcaaggcggctaacaacttctgtgaatcacgtagatctaagggatagttactacctacatgcacacacgctccttccacctctcttattagctgatgtgtgttgattagcacctgagttatcagaagcttgtctgggagcatgcatatcgtatgttttcataatttctgcaacgttctccgccacttgctcgtgagtgacagtaagggaagtgcagcggctgagatacattagcttttttggttggccatcaatagctttctcgcttgcgctagatcaaacagttttggaatcatgatgcaagagataataaataataaagcatgcgtttgctggtgtttgaagtgtgtgggttgcgttaaatcagggttctagtatgacgagcacatccagcggcagagaagtgattgaggttgagtgggcacgcacatgaagacttgtataatagaggagaagtagccattttgttcactttaaatatcagtgtattcatggtactagttgataaaagaaagggtgcaattggtgctcctccagatcgttcagcataactgcatggtcttcccttacaatttgccaactctacttttcaaacaattctggaatatctgattattattgaggtgagacatctggggcgagtagcttgcagttacctactgtatgcagaagaatcttaacaggtagttgacgatagccagagtggcgctggctcatccctgattgacggtaccgtctcgagatcggcgcctcccatcacggcgaccatgaagtagttgagaaacccgggaagacatacccctttccctgcactgtaagtccttccagcaattttatctccgttatcgagtttttttaggcctgcatggctgtgttatacatgagcatgccagatgtatgtcgagtgtcatcaaagtcggcctatatggtggctttgagggcgtagccaccgtatataaatccagtgtcgtcgcaggatgccgaggccatatttgcgcccgttagttggtttgaatccgggatcggattgttgatccatgtaaggccgctgccaccgcagatttaattaatcctcgaagataggaggaagctttctataactgattaatcataaaaacaagaaggacagtggtttaaacaggcgcaacacgtgtagattagtgagacatgtgatttaattagagtgaattgccgcgtgtgctcgactgctctagtgactcgatcttttagtctgtaggaaatcaaactggaaaatatcttagattctttgctcaacgtatgtatatacttcttgagagccaccgaatttcagttggtcattctcagaagaggggatgttctgggcccatgggcttaaacctcactgtatgatcattcgaagttcgtaggaattgaaggagactgggactcctaggtttaaggtactaatgcagcaagacgtgtaattagagaagtctcatgagtcctcggtgtcattgcttaggtagttggcaagagcaagctactgggattgccgaggatgccaaaataaatcgcaaaatcgtgcctgcaattgggctgtggcaggacaagctcagcgacacggaagaaattgctggaaatgtgaatacattcgttacgagcggccgattgatggcatacttgctcagccttctgagattcattttatgacatcgcaagacaacgtatgtgatgtttttctttggaaatctacatatgtcagaatgaagccgggcatattcaaccatttcgtggccttccagtcatatccagtagacagatgatttattccaaacatttggcgctctacatggcctcaccttgggagttgcactacgatgaagctcgtgaccgtgaagcggcgatcccggctttcggcgttatagcagcgatggcactatccgcttttctggatgggatggataaccatcccacctgtctggtcttcctatcattgcggttgctctgactggtgggggtttaatttgatttgaggttgctgggatcttgacagacgggccgtcaggctaaatgatactactcttcgcaagcggcaaattgaggggcattgggcaaacaattaattaaagagataatcctggtcgagtgcgcccaacgagaatttcacaatcgaagcagcgttgcaaccattgccggacacatgctgttggtctggctcctggaaatcggcgttgatggttcgtccctggggactgccacagcagctccccttatgcacagttgtggagcgaggaccaactccgtacctgtatgtagaaagggatgactgaccccttgctgtcgtgaatccatgcattatagaccaggtgcagtcgatattttgcattgctgcgtgtacataccactactgcgcccatacagagagtacttacacgtcgctgccattgacgggaagataggtgacctggtccgccgctccatagcgacgggtcagctaatttaagaaaagaccaggctcgacagctcaaattcacgatagagccgggagagaagagggcccttgtctgtctcgtctgcacggtgccgtgctagcacgccagaacgccgctagcaggtggcctcaaacactcctcacaaaccatggcccatgctttctttgctttttttacttattgttttctcttcgccagtgatgaaaacgatgctgtgcgtgctcacgtcacatcgcgagagtgtactgcttgaaacctaaaccatcgcacctggacagacgcccattacgtagggagctgcgaggggcgagcaaatagtagccagtatttgccctgtctgctggctcccacctggtcccccgctctccagctggccattcacagacggctatcgcaggtgttgtgcatgtcttcctgcatcaggcattgagggcccatcgtgtcgtgtaccttttatgcagcgcgactaacacctgagcctctccgcatctcatcacattgccctcatccattcttccatttgttcctccgcggacagtcctgcgagggaggcacaagccaccaccatcccgccacatcgcgttcgtcctaattagcggccaattcgctctgagacagcctcagtcccttagctcccagcttggtggccggtttcagtgctgatagttcagtttgcagctgccgctagccaggatcgtgcgctatgtcatagcgccttcagcgacctgcctcaactgcgtccccccggaccccccctgtagcctagcgagcgcggcctggtggccaatctgcttctggttagagaccaaccaaccacctccgcccgctccaaatttcgatcccttcttgtcgaacctcttcacccgtcaagttgcccagccctggcttgcctctctacgcgcaatctcacgagctggctgagggcagccgcatcatcccaccagctatcgcgttgtcaccatctcgcatggaccggtcaactgggtgagacgtcgacgaattgccttccctgcgcctgagatccggctgccagattcgccccttgtcctcgcgacctctccttttcgtcgactcgatattagcacccatcagaccattctgccgacactcgctgccctgagcaccagatttcccttgactctttaccatcctttctcctacgatatcaaccacctcagcagattccaatctcttacgaaacactcgccgacgtgcccgtatctcctgcgtccagacctggggaacccgacacggccatcgccactggccgccggcgccccaacgctaaacaaagcgcgtcgccatggcggctatctctacgtcacagacagcgacgaggacgctgactcctccggacagcagttatggacagagtgcttcgtgggggcagcatgaggatgaccacgcccaggtgagacagatctagacgccttcccgactccttgagacacctctttgcccagctgccgattgagaagcaccgccatccagtgaccaaatatgagtgttcttgttactgatcttccttggcccaaattcagaaccatcatgactttagattccccgccgattccaatcattcctactcgaactcaaactcaaatacgcaacctaataataactacatgctgggggctcaaatggcgacgcaacgcatgaagtcggccgacgagcaggctaatactggcaacgcattggaggatccttctcaccatgacggcggaaagctgttgccagagttcacaccagaaccacaatctgccgggaagagaaagggctcggacgacgacgacgatcagccatgggtggaggaatatgcgacggacgactccaaatggatccatcgtgataagttggctaaaattgaaagccaggagcttcaggccgctggattggttattccaaggacgcgggcccccagcaaacagcgacgagaccgaagccggagcaacatgcgaccaggaactgaggcatcggactacggccagagcagatcccgaaagaattcatcctcagtggaccaccgccctcccgagatctccgttcccagctgggatcttagaacgcccgaggaaattgccgaggcagaggccaacacatacttcacgtccaacggactgaagggtggctcgaaaatcccagtggctaagacgagcccgctccccattggggcgggctatctcggcggaggaactactgggaggaaaaacagcgagagcccggaagatgattcgtccatgtctatgaagagacgatcccggagtgcaagtgcaagcctccgaggtttcgaaaaaccaaacctgaactcgactggacccagacgatcaggaaccgattcgtcacccaagaagtcagctgggcgcaagacatccggcggcatgaagacgaatgcaaatgcaagaccaaagacgcgttcaggaagcggcagcggcaccagaccatccactcggtctggtgaatcgcccccgactaagcaaccggagggagacccgccgtggatggtcaattcttacaagcctgatcctcggcttccccctgatcagcaaatgttgccgacggtagctcgccgtcttcagcaagagaaatgggagaaggaaggcacatacggagatgtatatgacaaagatttccggcctttgaacgacaaggcactgctgaagccccccgagatggttcagggtggcgaccacaacgatgagcatggagcggacggtgaccacctgcagccatcagagtggcctctcaagcagggagagtccgcccctcgaagcccccgtgtgaggcaaggctcatactcaaccatgcccaagatctcggacaagactcctgcgacccccacctcggcaaacttccaaattccacccagcccccagccccatgggcaaactcatacacatgtttcttcacaacccaagagagtccccgaagagaaagacgaggatgccaagaagggcggttgtggctgctgcgtggtcatgtagtctcaattcaagcaatgttgatacgtgagacaccagtccacagtgagaagcatcatccaacaatcgacttggtacttgattgggacaacagacccttgacgacgttatgaactgcacacaccagcttttgacttcgagccttgttttatttcccaccttacatatactcactcgtattgcacaatacctccctccctagcgcatcgactgccgcattttcttttgtcttttcaaacccagagatggccacggactgacccacgcttcatgctcacgcctggatgacaagaagctggtttctcgcccggcgcatgagcactgtcgagacctcgtcgtcttttactgcctctctcacaaataccaccacctatggttgagcattgcaactctcgaacccgaaatataatcttggcaacattatcccttttctagcaaggcgtttttgccttttgaccttttcttctccactgcttccagccaattgtcttcgccaagggataagggggagccctctcgtttcgtctatctagcattgtgggagcgttatgattcttgttataaagttgtcctttttctctctttctgcctccagcacttgcacataccggtttattcgatcttctctttcaccccttgttccttttattgccattggtgactttttaaaagtccatttacactgttcaagggggagcggaacatattttttgagatttcacagatggtctcacgcccaacgggggaatttactggctgaccgcgttgctcgctggtcggcctcggattaaacttttccttttactctttttccacttttaggtttcccttccttttcgcattcaagagggggtatagatatttcgaggtagatgaaagaattagtgaacgaatcagttcttacgctttgcccccctgatcttcatgtgagtttgagatttgcctagaggaagttcttgggagaacggaggatcgtgatggacctagcaattggctaatcgagggcgtcattgacggttgggacggccggatctggcggcaagggccgtcacccgctgtcagagtctccacgggccattccagccccaagttgccgcgtgtttagacttttctgcggcatgggaattgaacgcaaaacagggcattttgaattgctgcttttgaatgctgttacatcatagagtttgggcggcctctgggttgcgtaaccatgacgatcgcttcaagatgcgatgcggaggaagagggagggtatttgatggtttcattgtcgttcttttctaccaagaagacggctttcagatgcaattgtcgttcggaaattgatcgtgttctcataatctatacttacatatttaattgagccatccaaaattaccaaaatggttgttcaacacggcgacgagcatcacatcccggagcaccaccggattcacaagtaaccccccccccccctctcgctccccatcaccgcatcccgtcacaatgactgactgactgaccctgccacctcagaccgggagcatggcttccaagggaccaccgcatccatcgcgagttcctgcaccgggccaccaagcacgtggacgcccaccccgacaaggagctgacgcccgcgctcaaggagttcaaagagttcatcgagacgaccccgcgcatctacatgcactttgtgcagatgttcgaggagatcccgaacaagcccccgtactggcacgaccccacggggaccccccagatccgtgactatcgccacatgctggccgtcctgaatcatattgttaggcgggcgccggagtggactgatgctgcggaggcggtgggtgtggttggggtgccgatgtgtgctattcttgattatccgatggggactccgaggtacgttattccaggggacacttgtgtatttggcatccttttgtgagctggaggctgatacggaggaattccagcggacatgcagctttcttggatcccgacgtgaataggatgctgaagaaggtgctgaacgaatggggcaagtttctacaggttcgtctatcctagctctgtctcggtcattacttccagggcgtgagaaactaaccatgaagtacagacacccgaatctgcaagtgttcttgaaaaccacaagacaggttggtttggtgaggttggagtcaaggacttgatggaggtggccaaccagccttactcgaccaaccacaagttcgaggacatgtatatctgtgatccctcggcgaagcactatggcttcaaatcctgggatggtaagtcgacttgctccgatgaaaaccatctggtttccccaagccatatactcaccccttccagacttcttcacccgccaagtccacgacagcgccaggcccgtcgcctcgcccgacgacgactccgtcatcgccaacgcctgcgagtccaaggtctacaacatctcgcaccacgtcaagctccgcgacaagttcttcgccaagggccagccgtactccctgctcgacatgctcggccacgacgacctgacgcacgagttcgcccacggcaccgtctaccaggccttcctgtccgcgctgtcgtaccaccgctggcacagccccgtgtcgggcaagatccggcgcgcgttcctcgtcgaggggacctactttagcgagccgctcttcgaaggggtgggcgatcccaacacggcggagatcgactcgcggggcatctccctcgtccaggggtacctgtcgtcgctggccacgcgggccgtcatcttcatcgaggcggacaacccggccatcgggctgatggcgtttgtggggatcggcatggacgaggtgagcacgtgcgacatcacggtcaaggagggccagcacgtcaagaagggtcaggagctgggcatgttccactttgggggttcgagccactgcttggtgtttaggaagggcgtgaaggtggacgggttccccaaggttgggagggaggagaatgtgccggtccggggcaagctggctgttgtgcataaatgaaccggatgatgctcctgggtgtttgggctgataccaagctcgaggaatatattgattgatttgaggaaatactgctttgagaagcgtgttactggcacgtatgacatggcttgacttgtaatttggctctaagattgtaaggaatgtatgtaattagccatcaacaacgaattcagttcatcctggatccatcaaacaaaagcaatcagaagatagtgtcgttgagagtaaaaagagaggtatagttatatgtgagagtgagagtgagagtgagagtgagttgtgagtgtgagtgtgggcaagaggcaaaaagggatgctaattgacccgaccacgccaggagtcgaacctggaatctctagaggatggtaagaaccgaaatctagcgccttagccattaggccacgcggccaattaacgtgacagaggtgatgacaatgcatgtacatcagctttgcggctggctgcatctgtcacacaattcaagattcaagctcgcagtatctgttacgtgggaggtatccaatggtcacgcttggacggcgcttcgggacgtcatgttgcacggccgaggctccatgtctgagttcagatggtgtccatgagacacggcgcacaagccaatcaggtctggaagcacaggtaccacgcaacggccgcttcaccagtgctacctctacggagcaaaggagagtgcggcccaacgtcacccgcgagatcttgtcagtgcagtgcagcgtcacggcagtcgagagcactagcgagggtgagtgaggcccggaggcaggacgggccccgcgctaaacagtgataagcttcgctcaaaagggcccaccacctataaccaccggcaacatcgagaatctcagaggaccgactcgacccaatccttaactcacgcggcaattctactcatcgccgcgcgcagcctgggggcaccgtcagcaacgcagagacgacgcgcagagcaggcattggaagaatggcaccgcccgcagcagcagccgccagcgcagacctgctgggcctgctcgaggccgcgctcccccaggacagtcgccaggcgctccgctcatcggtcctgccggcgctgctggacgccgtcgccgccatcgcccagacgctgcgaggctaccacagcgtgtccgccgccggcaccgccaatccctttggcgacgaccagctcaacgtcgatgttgccgccgagaacctcatccgcgacgccctggcccggtgcccgtccgtcgtcaccgccaccagcgaggaggacccggtcgagaagccggtccagcacctcaacggggcctcacaacactccccagaacagccctctcccgaatcatcatcagcagcagcagcagcagcatcatcagagacatacaccgtcgccttcgaccccctcgacggcagctccatcatcgcccccaactggaccgtcgggtccatcgtgggcatctgggacggccgctcctccctcggccagtcgccgcgcgagaagcaggtcgcctccatcctgggcttcttcggcccccgcacaaccgccgtcgtcgccgtgcgcgtccccggcggcgagccctcgtgcttcgaggtaggcctcaccgacgacggcgtgcgcacgtgccaggtcgtgcgctcccaggtccgcctcaccaactccatcgacggcgtccggtactttgcgccggccaacctgcgcgccgccgccgagagcccccagtacatggccctggtctcgcactacatccagagcaagtacaccctgcggtacagcggcggcctcgtccccgacctgggccacatcctcgtcaagggccacggcatctacgtgtcgcccaccaccgaggcgagcaaggccaagcttaggcggctgttcgagctgtgccccgtcgccctggtcatggagtgcgcggggggcgccgccatcgacaccgccgacggggtggacattctgcaacggccgctggaaaacgcggacgagaggggggggctggcgtgcgggaatcttgaggagatagaggtagccaagaagatgttgcttggcatttccaaatgaaataatatgccccgagcttgaatgacgtttattgtgtctcttggtgtgcttgttgctcgctcatcgttctctctcatgccgccatgctctccattctcatcctggactaaactagtcttgatgatatacatggtcatcacttacattgcgtctatgttacggggttaccgtaacaagtcaacgggctcaagccgaggtggcgatacataccaaaattaaatgcgcggagcctcgtctaaacaaagcgaccggttcccttgttatgccttaatcaaattgatttctaggcagtaaatggatggatcacgggacgatgctaggaggtgtggttttcgaagctgcaattggctgtgatggataaggttgtatttggcgatggctatcccttcccccttgtgtggccttccaacgtcatcgcggtggcgaaacctccaggatggaagcgaacccttcacatcccaccaacctcgcttccagctgtggctgacattggaatcagcagaggcagcgatcaactgcaaacgttgccgcgagcctactcatatttgcagtttccggcactcgagtgtcgtcaccgatgtgccaaggatgccatgatgtagacagaatgaccatgatcagttcagacagggttcaagtttttcggctatatattgagagctttctccctcttcagaccaaacgatagatatcaattcaatctacactttttacaacacacagcttttcaggaactttacaaaattaaaacatttacaacataacatcaacatggcagcagggtaagcccaactgacagacaagaaaagtcttggttcactctttctcacccaaaatctagtcatcgcagactctccttcaccctctcgcccgcctcgcgagcaaccaagagagtaatggagcagcggaatgagaggcgcacgtccgtggaatcagcctcccgccgctcgagcgtggcggatgttccggtggtggagattgctccttacttgagggatccttccgagagatggacatgtgcgaacaggatcggttgatatggaaagttgagttgcgatagatggaagatgtacggagaagcaaattgaagagatacatgtaccaattgagaaaaatatacctcttttcatgttcctatcctgtttctaatactttccaaatttatccagtcccaagaactggcagtgtggtatagctgctgatgtgcttgctaccctatatgcgttgacgaacccgttgagtatttcgttagtcgctaatgttctttcaagtccaatcttctttgattgattctgaaataattagagagaggtaaaggtgtatgtgtaattgggccagtataataaatttaaggacgaattgttcgagttcacagctggaaggttcttcatatgagatatcatatggccccatttcttcaactgatagacactgattatatggaatggcagtttccaacgaatgcagcacttgttccacttgcaaattcgacaaagcgtaataattagaccgggcgaagtatgcaactagaagagaagctgttaaaacatggttgaatttctctaaaggtcaataaggtactggcgagccgatagtcagtcgatagatatcggtcgcttctagcatataaccatcctcattctactcgtaaacataagagtgtgagtttgcatcaaagaataaatcatagcatagcgtattgagtgcaagacagtgagaaattccttgaataggtaggatatattattatgggatttattacctgtagttccatgtgcaaaacaagaaaaatcatcttgtttgaccattagaagttcccactccgaaagattatgtacttgaaattcctgctataacaaatatcagagaattcaacactatgctggtcgttggaagaggccgttagaggaagcgctggtgacgcccaaaggctaccatcggctctaagaattgccgaggttcgcgaccgccgtcgcaccaaaaagccggacgattccaaaccaccactgcgacatcttcaacatctgacacgccacgagacctgaatgcggcatcgcgcgggcgcaatgtctaagatctccccgtcgctcaaggcgctcatcaatgcgtcctttgcgcacccaggcccaaccgctgcgcccgccgcccagatccgtgaagccttcgtcgacatcgcccgcgatgcttcaaggcgccagctcggcccgcggtcgtggatagtcctctccgtacgcttccccgcccgaataactacccccattgaagcacaagaaagaaaaactaacaggaagggggggggaaacaggccgccgccacattcaccctcaactcccccgactccctcaccatcctccacgacgtcgcatcctcccccggccaccacaaccccaatcccagcgaccccatccagactgcagagctcatccgcgaggtcggcctcaagtgcatcagcttcaacggcatcccccgctccatcaactgcctcaacgccttccacgcctccctccccgcctccgtcaccgcccgcctcgccactgcaccctcccgggccgtttcccccgagtccctcccgcaggtccggcagcgcggccgcgacctctggaagtccatctaccgcccgctggacgagaagctctaccgcaagctggcgcgctcgcaccccgacctgccggtgcacatcctcgacgccaactacggccctctgctggcggatccgcccaggactgagaaacaagggctggcgagcgtggggcggctcctcacgtccgtcgtcgccattgcgagcctgagggcgcagacgggcgtgggaccgcaggtcctgtcgcacgtgtacggcttgcgcaaggcggtcgaggacggctcgttcagggaggatgtggtcgcggagggggacgaggcggcggagtggttggcgggggatgaggggagcgagtggattttgaggagtgttgatcggatcgtggatgttttggggggtgggaatttcgcggcggggagagtggtcaagttatgattgcgatggctatgacagtcgtctacgagggtggtgattcatgagagactctgtctgggagcagagcccgcatgttttggagcgtttagtttcgggagcgagatgttctggagttgtgatattgctatcacgacgtcttcacgatggccggcaagggggtgtactattatctggcctgcatacaaaggcgaccaatgtccatttcagccatgtagatacttgggatagaaaatctgttagatatagaagctgccctgcggaattccacactcaggttgcagttcatacttcgttgaggggaaatgctctccctgcatggaggcacctttctagaggcatcagccaacacggcagactcgatctgttgagtttacttcctgggtcatattaataattgggttgattattttgatattgtgtcgaaatcagaggctgtatggcggccttggtatcaagtggctgagataaaacatgacacaccaaagctcttttcacgcaaggcagggacctcgttttcaactaaacacaataataagggaataataaactattctatgatatttcgcttgatatgatattcattactagattaactattctgatattgtattggaatccaatgctgaactgtctcgatatgtcatgttttatttcacccacttgctagtgtagaagggcaaacgttccccgttgcgagggaccaccaagccaaccttgcttcaatttgaggcaagagtcccccttttcattacaccgaaacagcctagcatttcatcttcatgagaaacttttaacggggacgagagaaaaacgtgtttacgaatggatgtccttgcaccgaatgtatcacatggagaaggcacccacaagaactgtttgatagagcttgcgtaccatcagcgaatatttctacaaacgagcattacctgattccgcctcctgtttgaccggaatggagctgtcggagatggagatggttaaacttcaagctacgcatccaagtggacagtccgtcgtgtcagaacaatggggtctccatgtggtggaccaaactgcgacatttcgcaagagccgaacgatgagaggaagaatgaaacgaggatatcacagactactgcgaattacctttgacatgtgaaactggtagagacgacgcgcgccgctcaagttgcggtgtttcgcaggaccgtgaaaatcccgattattgttgactggggtgaatcctgtaaatccatcccgaatcgtcggacccgagcaaactccagatatagaattccccatcttaaccgttgcaattcccatgtttgagccttgaaccctgagaaaaatcccaatatccgggtccaaacccccctcctgcaatttctagagctgggcaccagggatccctcttggtacccagagctgatctacagcggaggagcagaggggagcctctggttggatgaaatcaaaagatagcttcctaaagcagcaaaagttgggaatcgaagaggattcaatccagggccgtgcgcccagacggaatttgcacaacctccttcatggcagaggcacagaacggcgcagcaatgcgcggttttgctggcagcacatggagaagactcctctaaatttatcccgctttgccgggtcacaggagcaataagcttctcaccagcggaatgcgtggcactgtcgacctcgtggccgtgttgggtttgccgagatgtgcgaccaaaataacaacccctgggaattatggagcggcgacactgatgaaacgcccggcagggttgccacgccttctaggctatgtgccgcaagagggatgcgaggagggtcgacataagcaactgggcagacgaattctgagttcagggttttcgttggtgatggtgaggggtgagtcgatatcatcagaaatgcacacccggtcgagactggcagccaccgcagtctgaacaatgctggaatccgagccgtttgaggctagaactttgaggaataccacgaaggagtgaaatttcagggtccaatgggctcttagacgacctagcagtgagccattgaatgatctagagccgggcttcgcattatagaacgcccaagcgcttgtaaaaataacacaacagcgcctgcattgtccggctcatgttgaggcaaccaatatcgtggctgtgggagcgcctccaagcgttctaggctcgtccgcgttcctggctgttttgtacggcttcatcaacacaatagtgagcgccacggccaagaaaaggcgcctgttcccacaacattaaatttggcctcgataatgagaggcgggcaaaatccccacgttcttgcagcttcacgatccacagctcgggcggctatcgtgtcccgcaatagtgtagagaatggagctgcatcaagccaagcctcgatattgcagctctatctggacactaggggaatgatgatgcattatttacctgcatagtgcaatatgcctgatatcccgccctaacggtcttccagggagagggttcgaggccctcttggatccgcagctcgttgattgtggcttttgatcccgtgagagttaaagagatctagacctccctgagtcagggcgcaagtccacatcactctcgtcacatattggagcatccagagcagaagctagtccaaagtaattattcagctcgaaccattgtgaattttgctatctggtatatatcaatagtctaacaagatcaccaatctcggtatccactgaagagggcttccctttctctacgagatcacacaaccacattaaaggaggcatccaaatgatatcaagtcactgtctgatccttccaacacttgcacccagctgttgcagatgatggtccctaagaacaacgtcaccctccccttgccttggtgcccgtagaaaaagatccatgaagcttagtcgtaggggacctctagtaacaccatacgataacggatctcttggatttgtagaaggcaaagtcttctggatagtgatgcgctgcgtgttgaccggctctaagcgagcaccaaatcgtgttgtggtagcgccagtgcgttcttcacgtggaaactccttccaatgttcgatgataattgtctcaggcaccaagggatctagctttacaagtagaacgatcttcacctggtgttgtgaggcgctgaaccaccatctcatttgtcgtcttaaggcgttgagtgattgcgagtatccagcctcgatcacaagagttggccaagggtgtatgttgtcatcgcgctcacttgggcctccgcctgaatcaccttctgaggcaccaccaccatgttctgctcgtagtgttgtctcgccgtattcgccccaatcatcttctaagcccatagctgtgatctggttctcaatgagtttgatgagttttctgtgacttctttcatggcgaaaggtgggaatcacgatgatgagtaggcgctgtgctggggagaagttctttaagcgaaatttagagcgttcccctcttgcttgttctatttttgcaaaatcctctgtcgatacatctagtagaatcaagaatatgagtactattaaaaaaactagacttttttcactcttacttaccttcaacatagatgacatcgctcgaagactggcggactgctcgaagtagcgcctgggcggtagtgaatttgatagtagccggcccatatgatgcagcagatatagtggtaggattggtgtccaccgactcaatatctgatgaggttgtagacccctgtcgaagtgctggaatgggatccatttcgtcgagatggttggtgattggggcaaggatggttttggaaaatgaaagtggagatatgcagggctaaatagctcgtgagtgggtggaatcagggcggcacgtgacctcgcaaatcccgctccttccccggcaaccgggtgacataagacattgcacacgcaaatcataggcgttttcaatcctcagtccaacagctaaagcctatcaaaaatagtaaattaaaactataaaatagtttctagaggcccaaatattaaactattgtctttaatgagggtaaattatatgtttattactgggttattgggctattaaagtgaagggtttggcgaaatgggggatcaaagtgccattgggtgtgcaatgtcttatgtcacccacttgcccggctagatagtcatgcaggaacatcacaagcaaactgctggaaaagtggttagccatgaacaaatgccttggccattcgtaatcatgccgcccgtcctatctccatgattgctgtgtcatgttggtagtttgcaagtctcgttgcctatggactatggacaccccaacggtgtttggacatttcggctcacactgcacctagagctagtgtgacgcccgctagggaaacgcaatctgctgtgagagattggatgctgcctgatcctggtgtgatttcgaggctgtgttcaggcgcccgcgggcatccgttgcttggggtagcccgacggtcatacgattgctgcaaggcaaagcaatcactgcctcggctttgtcacttttggatgatgactgtgccaaccgccgttctgtagtgaggcagcaaacagcacagccgtttcagatattcataaccatcggcggggcttgggtaggaacatgggtcatggggctttgctgagagctggctcttgtcattggacagatgagcaacgcccgtggtgacatctcgagtgactagcagtaaactctagatgactgactggccaattcaaggatggcttccgggcgcgggaagcgaaccacgagcctcgcggactggtggcaagaatatgtcaaaaacaaaaaaacgttgcgtaacatgatatgatacttagtcttgccggcccgtcgtcgcatcagatccgaactagcaataaagtaattgaaggtctggaagcagggtcgagaaataatttcatttcaggcaggaaaaaagggtactgaacccacaaaaaggaggcgaccgttctagatcttccacaccatcgtttagtgtcgtctggacagcggttcacagaatgaaccgggccgagctaggcagattaaggtgccggtgatgatgggccgagcgtccgttggagtgagcttctcctagactaccctctcgtctcggatggaagactcgagtagtgaagaatatcgtttacctagtacgttatcctgcgacagtgagacgcctggtgccgtaatggaagactggctccggctgcgtccagcacagcagagataaaaatcaagatttgccagccgactgataccctgaaatccgccacgggatgttgtgcatagcagcacccttggcgtgacatggcacaacatgactggacacggtgattggtggttgatgctcggcttgatcagagcagtggcttgctgagcgggaggtggtatgtcagtgtcaagcggtaatgtagcaatccagccgacaaatagtttgtctgagtatgaacacgaacacgcacacgcacagctcgatacggctcgatggtggtggacgtggtgggggatcgccagcatgtcgcagtggtgatctcgatcctagcgcactccaagcggccagggccacgatggatactgtctgatacgatggccagaataattacactactgggactgtcgctgtgtcaggagactgcccggaactagcgtcttgtgtttgtttgtgtgtgtgtgtgtgtgtgtgtgctgccgtgcatgcaatagcggctcttggtatcacccacctgtcgaggcactggttcagatatgaggaagaaggcccttttgccttggtggctccagctcgtctggcgaaagggggtgtggctctaggttcccgctctggctttgtttcatcgacctcgatctgtggcctgggccgtgcttgagattattagggaggccaaagcagcaggaggaactgatagatgcacgacatgtttaaattatgccgagggatggcggatggtcgtgtgcgtgcccacctcgcagagtgaccaggtacggttgacgcggccacagaaaagcaagactcatgtgtgtgtatgtacgtggatattgggtggtgaggaacatcacttgagacactcgctgcaccagtgacgctggatggctgtccagagcgcaggagggtgtcggggcattgcgtgctcggacagtctcgcgagaagagaatcggagacagcagcgcactgcaacgccaatccacgtcgctgtgaggccatccccagatcgcgcgctcaaattcgtgatggcggcaggaaatgagctgagcggtggtgcagcaacagacggggtggccagtggtctgatagggtctgataggcctgcggtcctaggccccttcaggcgctgccgggcctctgctgcccccttctgaagatcgaggtttggcagcttcatcagctggcccatctcaaccgcctccgtgataaagcaatgatcgcctccccacgtttccgccgaccgcgacaggccgggttctcggactgccagactcagacatacgacagacgtgtgagagacagttggcggccagtctcaggtcgatcatgcagctatcggggcagccagctttgccgcctgcttaattgcctgggcggagctttggactccggcgctgctgcccacaattccaggtacccaagcagaagaatctccatctccatcatcccaggccacagtaaccattccatcgagagcccacaagccggtgtggagtgtggaaaagtttttttttttttttttccttctctagcttttctgttctctgtccctttctacggtgctacgtaggactgaccccaatcggacacctcatgccaagcttgacatgtgttgggcaacatgggcacaaatgggcgacgggccggtgtcaatgcgaacgcctcgtctgacaggtcggtcgggagcaaaaggagacaaatcaatggcgctagatctccggtgcagcctgtctgtctgtacgggtggtgctcccgcacatgtgaaacagacgtcgaccggaaataatgcttgcatcacgacgcctttctcaaggagatggataggactgcgacaaatttccgaacttggcgcgggtggctgtcaattaattcattcattcattcacgtccgagcctgccgccgtgcttgtgcgcccaagcctcgctcgtccctgtagtcccgagttggtctgtatatgcggacttcgtaggacctcgctgtgctgtgctgtgcgcgagggatcattaagccaggccgtaatcccgctgatctgtaagcccggctgctgatgctgattgaccggccttccccttgccgggccaattcatcagcctgcgaacacgcatccatggactttgcggtgaccgaaaggcaggcagcgtctctcagccagccaagcctcagcccaacggctgagacagagttttttccaggcctaattgaccactaatgacccttatccttgctgtgagtcaacctcttctcagggaccaggataggatcgccaactaactaatgtgtacaccgagcctcctatgccagcacagcagcgaacgggccaagtaaacatcaacaacaaatcctcttctgctacaaagggctgtccgtgtttctgtggttaaaaacagcacagcagagtccagcgcactaagtggaacagcgaggcgggatcattgaccaggccgaggaccccgtagcatgaatcaacggttcttgtgtgcgccccgacaattgcttacgataggggatccttgactcttacacacggtacgtattcatcagtcaaacaagccagccttactgctagctgttagcgtctgtccgaaacagccgagcagtcaatcgatgccgctccagacccaaagtccaaagcccgcgttggagattgggcaaaggtcaaaaagggggtgcggcttgtccgtcttccctggccttgcccgtacgcacacccccttgccctcaaaccctagaatcgctgcatgttgctgtcctagtgcgcagagggggccgatactttgaacgcaatacacaactgtggtgaattgttttaatagccctctctgcttgggcttcaccccatttattcatgcccgatcggattggtaggaagaagaagaataaaactgccctactatgtgtctggcgtgtctaccggagctctcgcttgtgaaagggtgccaagtagaatagacgaaaactgtcatcagattcaagtgactgcccaggcgccagcctctcccctccacgcaaaacacgtacgcaagcacacacacacatatgcacttacatgagaggcacacgctcgcccagacagacagggagggcaaagagacgaatggctcgggcggttggcgcagaaccctgctgctgcagcggactggactcacacccctcctctcctcctcgctagacgcatttcctgcaagtcccttttttagcgctctgcatccaaagagcggaccggggtggtgctaccttagacccaggaccgaacgcgacctctcatcccgatccttggctgcaagtacgtacttgcttgctgctgtctctggggggggggtctggacggtcatcggtgatcgtcccagcccgtggatcctcctcaggttccaacgccaaaaacctagagcagagacatgcctttttctactgccgccctcccacctcatcctgctcgccggctcttttctgcacaatccatcatcctctccatcctctgctaccagcaacgaccctgctcctcgacacgcctcgagaagcaacagcctccaaaagcatccatctgactgatacgcacctgtgctgtgctgtgcttacacactcacacgtacacacacccttcccagatccttcctcgcctgccctgtccacaggcccgcttagctggaacagctcaaactacccacgcggacttgttaccaggcacccctttgcttgcttgattgctggctgggcccccggacctattttacttttagcaacctcccgagcaccggccatctctctctcatctggacctccatatatatctaccaagatgcccgcctcacgaccctccagccagcactttgattcatcatcctcacgctcctcatccgactcggacatctcctcagcccccgtatcctcaggctaccgatccagcatggacaccattcagcaacccgtcgcctccgtcgagatcctgcgctgcatgcgctgcgctcgtgccgtcgagaccacctcgaccgacgacgccagctccatgggcatggtccgcatcgctcacaacctctactactgcgagcggtgcgccaagattgtcggctacaaatagagagctcggcatgaagccccaaaaaccacccagcacctggactggaactcgatataattttctgttgacaaccaccaccgcaacctcctctgccttagcacacgattacgagacatacgccctgacgaacatcttgatgacggatagacctagcaacatggaaggaataagatatagactcgatacctcaccccgcgctgtcatgcagcagcagcagcagcaactacgtcctggagacaacttggcgcacacgccccaatggtcttgaacaccagcctctccgggcagcaaccaccaccttcgcagcagcaatccctggacatgagcgcgcggcacctggtgatgcacctagccgtctcggtgcttgcactcgtgcaggtttcctgggcagtccgcattgctccgccagctcacgatgttcccgcctcaaacgggctgaaacaaatccaccccaggctcggcggacggccaatccacccaacttggctgagatccaatcgaattgcggtgaaatttctattatttctcctcggctgcgctgacagccctgtttcgtggccctatttggggttctttgtggctgtgtcacggccagcacaaaccgatatccacccacccaccattgctttcgatctacctcgcaagtctggcatcttatatttttttttattccagatgcctttctcgatcaatcccgcaggccctctcggtcgcttggcggccacatctccgtctgtgagacatgccgagacatatttttcaatggtgatgcgcaattttgggggggcccttcttggtgcgcccgcgacgttcgtcatcgtgcgtcgggtcgtaaccacccttgccattttcctctagccgcctttttcgcctggaccagcctgtctgcagtcattgcctaagcggtgcatcctttcgaacaagcccatggggggggctaagtgccggggttgcatgcagatgtgacctgtctccgctcgccatcgaccaatgagcgaaatgtcgccaagagccctcgtatacctggatgcaccccaacaatgaaacctgcaccgctcggcactcgcctcagacaccatggacggtcttggcggcctctctttctttttcgtctggcactatatccctctctgcacgagaaaagaaagagagggccgtcggtccattccatggccctggcgatccgggacgctcactgggtccagaccgatccgaggagaacggcattactttccccgcggtatttcctggccgttcgggcctattgactttccgcctgtctctcatgcaggtcacgttgtggaagagcacttggggatatcagatggtggcagttgcgctcggctcagccagcggcaatacgggccaattggaaactggaatgttggtatatgtacaatatggtgtcatcggtgggcaacacggtgtttctttttttcttttcttttttattctttttcctattttcttttttaacctgtggcttgcgatatatgaccggccgtatgatcggagtttttttgtctttttacataactcgaggcaatgccctcactcacaacccgggctggtcccggatggcttgctcagaacccgtgaagtgccgaagagtacctagattaagtcaaagcaatattacgaatattattaaaacacaacatcccattatccattgacaaagtgaaaaaaaacaccacccatgcaagacaatttttatgatgtatcgcattcccttggtcgtctgccacccgggcgtacagcggcaccctgtgtcagatgaccaactaattatagtcccttgaccagactggtggtcgaatgtttccattgtctaggacccctcccccctctccctctccctctttcccttggctatttccattgagagctgcaaacaccgagtcttgctatagatcccagcggaaagtccgtggagggttcgtgtcggacccctccccctcccactacggatataagcaagcggccgggagtttgtgggggggggggggagggggaggggaaggtatgtatggcgggtggacagctgaggacgaggattataatgctactctacattctacggttgttgtttttttacgtcccgtatttttttttctgttgctacatcaataaatgcggacaagggggaaagtgggagggggggcgtgatttcagcatagcaggcaagatgggcatttgttattttccccatgttgggaaaaagcaaaagccacgccatcaggcgcgttgctgggtgttattggggagtgtaacatgcccatttgggaggagatatgcacaagatgagagggaaaccctaacatgaaggggcacttggctcggtttggcccagcgggaaactcaatgaggcgtcgggtcggtttggttgagggcggaaacagtgccggagcgaacggagaccctttcctagcggcctgtgaggttcttttgcggcgaatgggatggcgttgaagggatggcgtttgggaatctagaacgtcggcctgggcagaaagtttaaaattcgccctgggtggtttgaagcgaaggttgggcagcagatgacatgcgcctaggcagctagcagctgggataggaggctgtaagtgccgaggagggggttctgcttactgttcgcttcgctctttggggtcagagatcggctgtgtaaaattcggagtccggaatggccggcgagccctgaagggaagggttcgagaagagggcggagggtggagctttggtcatggatgtagacgatgtgagcgagggacgagtgcgacgatcagcgaagatcgattaggggttgaagtgcatcgcctcgttgtgagacgaccgtatcaagctgatgtgtgtggtatattggatgtgttgcgcccgccccctgaacgtggagggaaggatgtgtatctgttgatgccagggccgccaaggtgatttcttatccttggtgacgacaattaggatgcaggtggcttcattgtgctgtgttgcggtgtgcttggagttccaacttggacggtagcaggattgggctgaacatgatcctgccagcgagatggatccaggtctgacgacactgaagccatcatgagctttgcgtcctggcacgacggctggcggtgcgggagctgatgtcactctggctggaatggccatgcagggacttctctcgtgttcctggggatggtgtcaacctgacgtcgacgactttcgtttctgggctggtctgtcctgcactactgcaaagttgcatctgcgcaacagggtagccaaaaataaatacaaacctctatttgctgcttccttgatttgccggttggggtgcacattggggccgtcggtatcgttcagggagggggtggatggcctcattgctgcatttccagaggatgagccgccagccttggaaccacgaccaaggctaaaacaccgccttttcgattagtagtgacagtgcagtctcgtcttgctctgccagcgtgccgtgcatcatctcccgatacggcggcgacctcctcgtgatgaaccgagccggagattttaccagggactcacgggtagatacgagaaaagacgaaattacataactgtggcccatctgctgggccacagacctactgcgctggaccgccctttctcttggccaaacctcgtagctcgtggcttcaatctctctctctctctcgctcccctgtcccctcagagcgaaccgtaagcgacgctcaactcactccaatatttaagcaacacaggccagagggaagagggacagggggatatgctccaccactgacttcatcgtgcatgggccggtctctctttcgcactctccattcctcccactacgccagccgacagtctgtctgctttttttagtgcacttaccatccgggcgggtctgcccttctcgcgaccagatgcgataaagggctctcgggggaggatggactggggggagggtggacgctgctcaccaggtgactcttgatccggtttagtaaaggctgggcttggtgtctcgcttctcggaccggggttcgggctggagcgaagggggagggagggggtatgaatatgttcggcaatgtacgggctatgtgcatagtatatgcatatgtatgtgctggttctcacgcagcagaccagtcgcgagccagcccagggcgatagaagggcttggctgatacctgtgaggcctttgggacacgcacccggatttggatctgtgtgtacgtacgtagggccatgtccatgcctgcatacagcaggcccttgcccagcagtcaaatgacacggccgggatcagagacgcaccaccatggcacggcggcggcgcgttgccgtacaggtgaaagagtgcataacggctcactcagacaccgagcggggagggacggtggccgagaggcacagcccagagcaaggtcggtctgtggccagcccagccgagaatgcacactcatgccgccttctcgttgcctaccaggtggaactagcaggcgaagacatgcatctcgcttgtctgggcagtcatgggaacatgtggcgtgcgcccgctgcatattgagtctcgggcggctcgcacgggcatgggaccatgagctgcttgacaatgaagccaacaacacattgtcctccaggcagccattttagtagcacacctcctcgacgatggtctattcggtgaatcccgggcagcttgtgaaacgtacgcgccgggccgtgtattgcttcactgattgattgattgattgattcttgagcctcgctacaccccggcattgtcccccagacctccagccacctgacctaatcaacatatacagggcctataaccgatgttcccgcaagctggggttgaggccatgacagcggatgcgatgactgagaaacagtgccggggtcaaggacttgtcgggttcgagcaacgtgaccgccatgcctcctctctccgggtcgtccgaggggtgttaccccagcctgggctttctattcgacggccggcttagatttgttttcgcaagtcccaatttacagctggcattgaccacatgattatttccgtcagccagccactcagagcctcaacactccatggtgctgtcagaatatgaaaccacctgctgtcctcgttctctgcacagcctcttaagcgattgtgatatctttatgtctgccaagagtacacagtctatcctttggtggaaagtactgttcaatcttcttcgaaattggagagaaggggttggttaaatatttcgtaattgctattctctgtgacgtgactagttagaagttccgcatggaagttgtgtacttcccctgctgtgttccgagcacggccactccttcatgtagctgtaggctcattctattgactgaaatcgcccgactggaaagtttttttttgctttttcgcagcggagttgatgggagtacctggacagtgctccgatttggatgtaaggaggaggatcattctacgcgtctttctcactcactaaaagttattgagagcaatcatgcagctgttgtccaattgaatctgacctcgggaagtagactaaaatcaaatagccgaaactgtttaattacaccattgcagcttctcgttgatctgctttacatatcaatgcttcggttgatcagacctggcctacttggtcctgggtcgctagggctgtgggtagatttaatcgcataagacaccaagagcccatcctcattgttgcgtgcttagtgggatattcacttttgatcagtgagtccatctaaatatcatctacttttctatttatgtgaatatactccctgggagtggcggcgggtagacgtagctccggggtgtaagtgccatcaaaacgctggatgacatttatcgaacctacatccgagaccgcgcaacaaacgaatctgatcaacaattgggctctgcgtttttcaccaatggaatgatagatctagatcggggctgggacaggctccgttctttgcttatatattctcaatggggaacgataattctcctgaaaggtatctcaacttgctgaggtggctctatgggcgaaacaaggcggatacaacaaagagaagaacaccaaaagatgacttgaaacgtgctagtgacgttctcagtctcggcagctcagaaaagacggctgccagtggccccacgtccaaataagatgttgaagacatgcactgtcaacactgcggtctgcagaattgggtaagccaataacccatcctgttctgctagattgagtgtagatattcttgctcccccaaactttcctggatgagtacctggtaagtagtcgggtttttacagaatccaagagaattccttggaaagttgtcagaagggaagaaggctaatgactacattgacgcacttatgcgaagagcagccccggcgaactatgcttcgggggccgaggcaaacggtgtgtctcctttccagaagatatagcttgaaggcatcccattgagccgtttctagctcagcctaaagagagcgtacggaagcagataccaaattcaaccaagacctcgtttattgaaatacatagctgcctcacccgaagaaagtagatgtcgaaccaaaaagtgttttagctagctgagtagtagtaactaggtacctagacttctaacagctaaaataactcttaaaggtatttatataggaacatctaaacagaacctatctatctattagatccttgataaataacttattctctctttgtataactaaaattctactctgaatataaactctttaagacctacttacttttatatctcgaattatcctgcacatatagcatggccattgtaaagggaagtgatcccgcaattatgatcatgttccacaacaacagacgagtctcggccaagagcacgctcgataccttatataatacttccctggcaatctctttcaacaatagcccccgtggagcaatggtcagcgcgctccagcactgccccttgcgatatatgtactcgcgctcattatcagacccgtcgtaggtggatcccccctccctaggtaagtaatggaaggggacgagtatatcgcaagggggcgagcaggagaggtcctccagttcgaactcaagcagaagcattattttttcctctttccagtcttttgtttcgcctacatgtgccgccagcttccaacagggagggtattgttctgtacgagcaaaacactcaactgccgtcatatcaggcataactgcatgatggccaggtttactgacttgtttcccgtatacaccaaatttgcgagacaactggagtctacggacatgcttggaggagacttggaaactctttatcagctcactgagtgcttgtgatgctgtcagtggaagtctccctcccctccccagcaagcaaaagccttactgctgaaagaacagcccaacaactcgcattgtttggcctacgagcaatcactagatggagagcctggggagctggttgacatggtgaaacagaagcttgtcaaagcaatggccgcgaaagccctcatgaacgaggggtggctgtccaaagcccagagagagatcctgcatctaccgcctcgtgcgaatggacacattcttgactctcctagaggctcctgcgcggtcccttgttactctgctgttttgacgggaagtttcaatttggcagaagtagatagcgaacagggcgcgtgtgcgtgtcttgcttctttgaaccagtggacagtggccagttgttcctcgccatttgatctgctaccaaatatctcaatcccaataacagaccgattccaactagctatgttatcgcaacaaagctattgaagttcagtgtcatcaaagccgatggttacttgcaaagagcaaagtaggcggtatgtctgccagggcttagtttccatgcaagactatattaatcagaccagtctcgatggcatgtcttcctttctgatatccagtattaaatcaaacttgctgcacttcttgctcctctcttgatgctatggcttgtctgccacacagccaaaacaatcgcattggaaaatcgaacagtatttagattgattgcatgtaactgtgaatttaatttgtacctagattaataccaaacccaatcatccttctaccaacgccggccccaatattatgaacgttaggacttcattccaaagtacaccgaggttcccctcgagttgcgtcatgatcaggcgaaatctacctgacctcgttatgctccaaatacaagtcaagcctcctttacccctccattttcacatctgcagcgctatccaggttcttgagtagatagctccgtttgaaatactcgtttggatggacgatggtaattaactggttcgaggtgaggatctcctcggccttggccctcttgatttcgttctggtgtaagtgctcaaataccctacacaaaaagttagcctctcgcttggtcaagagttggttccggggcatcattttttttttcgccttacctgttacaagccatatgatgctggttcttggccttatcctcattaatgcccttcagaacactgctatcagagacccccatggcctgcaccagcgcctcgaggttgtccttgctgaagtgccggtaggggcagccgtgagcctcgccgggtccgggtgggtgctccgtcaggatcttctggcagctgtaggggctgtagccgccgctcctgcggttcgagtctccgcccacgtcgccgtagacgtgcctgacgttgtaccggtactccttgttgaactgctcctcggtgatcttgtggaacccgttgcgccagaacatcaagcactcctctagactgagaccgatacccttcaagaagagggtgtactgcagtcggccaaagtgcttcaggtgggcgtcgcggcggagcgagcgatggagatgcgacatgcaagcagggaagtgctgtgccaagttgtcaatgttcgcggccgagatctgtgctccgtcaggggcggaagtgccggacatgtaggccgagtcgggggtgatgaagttcttggagagatggttcagaataggcgtcaaacggtcgtcctcatcgagacgaggaagggctcttgcggtcagctataaaaatagagttagtcgtcatagggccgcattgtggaaatacttcttcgtcttacctcgagttgcctctcgagcctcgcctgaaactccacggtgatcatactggactgctcacgacctggtacataagccattccgcgcttgacgaacactcgacggctctcgaccagatcgggaacgcgttcccaatcgaccttgaaccatgtctcctcctcgacattcgtcctcctcgggctcacgtctgcaagctcagacgcaagctccgccttctcctcatccgtcacggggaggcaccaatccagattcaaactgttgatgaagctgttgcgttcattctggtcgtcgctggcaagtctcatccggaagagcatggtctcaaccctggtgaatcgtcgacgcaggtcctctgtcgatgaaaatgctaaccggaggatgaagtgactgtagtgatctttctgcctctgcaaggcgatcttggaggaactggtgttcgaatcgagcggtagatacttgtcgacaatggatttcatatgcgtggcggtctctgctggcgatttgttgcggaaggaacacgcctccagttccgcaaggacttcaacaaagcgttagttgaatggtaaaccagacggacttttggatcacggcaaacctcttaatctgtcaatggcccactgctcaaactgttcaagggtgatgtcggccgtgggcgcatctgcgtagaagttgaggcggtagggatagtcgacgctcttgtactggggcgtggcgaactgcctcttgcggtgatcaacgacattgcgtctcttggggtcgattctatcgtggttatggcgcagcatcttgacgaaattatgtcgacgtcggcagactcttctttgttgctagactcgaatttttggtttgctccgtcaaacgtcactacgcgtagtagagaagttcagggttagcgcgactttacgcgtcgcgggggctcgttgtggggaaaccaattaaaacaggcgcgttcacaatcgcgcccgctacagggtaggctggccgacatggtctcctctttgagtctttgagcctcatgctcgattgtctcgcatatacgctctgctatgaaacagggcggcggcggtgcaaagcgatcccatctttggcgcattccacacattccagttcaatatgccttctcccctccatacgtattgatcgccctcagagttgctggtagccgagacatgtgacgtctagtctacacgcatcacgcaactcgtagggccgaagacggattctgggcgaaggctgtgcaaaggattctcatttatacgaagcatacctgcgggccactcacgaggcgcagagcgaggatctcaaaacctacagaagagaccttttggcaactccacatcctcttccgcatctctggcccacccttaccccctagcacgtcgatcaattagttcctcggagggctgatgccttgcccatacccgaccaacggctcatgtcacaatcaatattccaagtccatctacctccaatgcctcgtcagcatgaagatacccatccgcgatgcatcccctaagcagaggagcaaaagaggaaagaagattctcgctctcgatgcgacgtctagccccaagtaggcaaaggtttgcgagttgtcgagctgatgagcggggggcgggcagagagagcaacattccaatgcgtcacccgtcacattgaagcggcccaacagcatatgtattacacacatagcatagccctgcgacctgcggccgaacaatagagggtgtgtgatgaatggcgcgtccgccattttgcgactggccatgcatccgaccggccttggcctggcccaccgcaggcgccttaatctgcgcacttctacgctgctgttggtcccgccggctgcgggaccggtcagagccttggggcgatgtctcatggcaggtttgcgctgcgggtttctcgctccatgatgcgcaattcaggcaataaatgcttctgcacgtcggatgggctcctctttctggagcttactcgggacatgacttaccattggagccccccctcttccccctccaccgctgagccaaccgcaggggatggcgttgaatcgcgaaccgcgagcccacgcatgcctctgttggtgctgaggagggaaagatgctgcgatgtattatgtgagatgaatgattgttggtcctagggacgcgaagccaagtcgtatccggtcaattgccagcgcaattgtcatctaattaatcaatcaagtcgtaagatgaacaggaaaggggaatggagcagatcatcagcacaagcgtattcgcgaatcgcaagacgtcgtcggtaggtacattcaccaaaaggatgcgcgggggggtccagtgagatcggtgtaagagttctataattccgatgcgtgtggataatagcggaacgagtgtgtaagctaattgatcccacgcaagggctcggccaaaaattgaatctaaagtcaaaaagcaaaaaaaaaaaaatgcagaagtacttcggggactgagccttgttgaaaagacaaaggtccaaaaaagaaaaatcaggaacaaaacatgcgggatagccaaaacagatcaaaaccagaaaagagaccaaaggaatgaataactctgcccaatgctaaaacagagggacggcaaagaaatggcaggctggtgaaaatcgcttgtatcaatgatgggtcgccccaatgcagtcagaacagtgtcgcaagcagatacgctccgacgggaaatcctcctcttctataaccctgtccacaccctccccgagcttgtcgtagtcatcaatcccgggctagccctacggacggcaaagagctgctcccgcttgtcggtcgtaaggcgggaggagcgtattcgtcgtgggtgtcgtaggtactgagaccaggcaagagccggccgcggcattggcgattgtccaagacagttcgggcgtggggagaggcgccggtgtcgacgccctcttgtagcatgaatccagaagcaaagtgacagaaataagaacgcgatgcaatcttgccgtagcaagtaaactcagagactagtgccatatgggttgctatttaactacatgcctaggttagtgactgtgtctttctgatgttccttttcggcggaagacgagcttccagtcgggactgacgatcgggattggccgccattgctctgccccgaggagctcgagtaaggctttccggcgccctggccgcgagtctcgacgcgagggaggaaggcatcgaggatggtgcctccgtttgttccagagccattggatgagctaccggagtttccaccttggggacgaggatccatgttggaaggctacagagctggtcagttatgcaggaacacggcaacagacagcgcaattgggaaagaaaccaaggaggccgagaggacgagggcagagagagagagagagagagagagagagagagagaaaggaaacatactgaggtggttcggtgcgttgaaggtggagagctgattgctaattgccagggaatcggtgggagagcgagcttcgtttcttcctttacagacacagacgcaagttgggaggcaatgggaggaattgctggtgatgatgttgatgttgacactggtggtgatgatgatgctatagcacctggactcttgtcggttcccatgatgaggtcttatactcgaggaggaagatgatgaagaaggagaaagacaagaatcgaaatagaaatggagaacggcgtagttgtcttctttgctacgcccctcgctcctagacgacttttgaataccgcaaggctgtcctctctggggtccagattcgtaaaccgagcgatggagaagggcacagaggatagcgcggcctaggatttgattcagagaggtcaataccgagagatggggccgcaggtaggggccagtggcggtttacgacgagacaggattaggacagcgaagtcagatcactaggaaaaggccatttttttggtgtgcgaaatggatcatgacttgtcaacggcacgatagcatgcggcaaagcaagctccagacagaattgcccccctctaggcaaatcatcgctgactggtggattgggggagtcggccttatgggacaggaatagcaatagcctgatggccagcaaggggtctgtctggcactgggctctttccccacggtggcaagtcctgctcgaggactgccatgcttccagagcagagcgtcaattggaaatgaaactcgtggcagcgcgtgtcgagcgagccaacgccgggacgaaaccaacaagctcttgatactagctcacgaccatatttgcccacctggccgggccttgcccatgttcggggccaacggtcccaacccatggtcacgccagccgatcatagagcttcgaatcagcacccatgcgccgccagcttttaggatctcatcaggggctgtagcgaatcggatgccggtagcctcagctctggcgcggagaggggctggcgtagacgcgatacaacgtccgagcacaggcacagaagaggaaacctttactgacttgcattggcgctccaccagcgcccattgcgctgaggctagcgagccattggccgctgcagcgctggcattgcaccgggctacctgctgcctacaattcaatgttaccgttcaattgaatcacgcaacaagcgcacagaggacgtctaggtagacatcgacaatggatccggacacgcggccatgcgcatgcgtgcgtgaatgctcggcttgggcttgaacccaagtccctcgcatggggcgggagaccaggccgcccaggcaccaaccaggcggcagctcgtggcagtgaggatcttgtgctgtgctgccttggggaccgtgaaactcgccaggtgagtcaattcccctcgcaacaggcgccaatggcctcatcgacgcccggatcgagtccagcgagtctcgcaccacatgccttcgcgagtcacacgagccaccgccttggtgctggctccagttgcgcccgccagtctgcctatccgatttgacaactcaaattcggtcgtactcaccaaaggtccctatcaaggtggcagtttgggggccgcgcggggccaccagcgaggctctgccgaaatcgagtctcttttaaattaattcaattgcctgattacctacctactctggacgacttcccagacagcgaaccgccattgccccacccgatgctgtgctttgccctgtctcttggctctagcgggcggcacaagcaggtcaggatgcaagatcaagtgaccgagaggacggattgtagggctctgtttacgtcacttgcctcgtactggtccaatgtccctcaggttgatgagtcctcccgaacggttcttcggtacggttcagcctcgccgaatctcacaaggctgtgatttgggggcctgtgcccgacccccagcgggcttctttcgacaaaagtcacctatagggaggctttccggatcggctgtttcccaaattccaggcaccgaagagcgttcatgcatcctcatgacgatatgcaccctcatggcggctgagtggctgctcccgatggctcctttgacatgtatacgcaagcaaggcagataaaagagaactctttttccagaaacagatatctccgaccagtagagcttttgtcttagtcccaatggtgaatgggcaatggccgcgttattaatagcagaatgtgcataacccattctcaaaatattacgatgataccacaatttccaagacatgcagatatatgagtaggagctgggctacttggccgaagcaatcttcactttcctactgactaaaagctgttcctttgagtgcaccaatttgcatccatgatttttcggcctatctcgcccgttacggcaatcgcctagcccacaattgcccacccaattagaggatccggagatgcacctcacccacctcctcccttgtttagtcaaagcctcagcagattgggatggggtgcccagagtacccagagtgtggactcgaatacacgagtacatgagtaaacctaagacacttctctcagtcacccatgacaggggctgtggttgcatactgcatctacgtaaccggcagcgcggtggtggtagcacaggccagggagattgcatacaacgtagcaatctgaagtcatctacctgaagcctagccaggaaacccattggctggagatcccgggcagcacgtccgtctcgactccagcggtacagttactttaagtttttaaccgtcaaacgggcgtgagtgatgtactacccaaggtgctgccaattttccaagacctcatctcaccccaactccaccggagacctgctccaccgatgattttcgggtgggttttgcctgctcagctgctgctggctcataacacgcagatgctaagatgggacctgtaaggcgaggtggagccgacgcccagccgggcgtgaagaagcaaatctctttgacggctgtgcgaagtggccacatccctgaagatcagccaccagcaatagaacgctagaaggtcggacacggactccgggcgcctgaaccccgaccatgtgatggcgatagagctcagcgagcacgttgtgttgatgtttacagagttataataggtgcatgtggcgaacctgcaagagcttcatctgggttccaggttgcctatatagcagcccgcatgggccatgtcgcgacaagcttccgatcggggggcgataaaccatatatttatatatattggagagtttggggcgttgtcagtgcgctgggcaaggctcccgggcgaccgctgaaacagccgagaaaatagggtaaggcgtgggagaggaggactgggctgatgcgacctactattgtgtatgtaatacatacttcccaagcgggcgcgatcatgatcggtttcctaaaagaatcaagccttccccttctccctcggatggaggtgtgcagcgatcggccctcgaaaaaaggcttcgactcgaaaacttgaaaaacacatgttgcatcattgacacttgatgccgagagaggcagggatatccaacgagagccaaaccctggcccccttcccgggcggccgaataggatagccatgttggccggcgagcagcccaggaatgtataccccctcccagacagacgtagccgtgtgtgcgtgctctctctcgtacgagatttggtgcgggagagacttgcagcacggcgaacgggacacgccagggctggctaagcgccagggagcgccgctagcgagaagcaagagcgagcccaacatccgacggccctgtaggtactaaatcgctgggccgattatgtcactccgtggcattttacctcagtgggaaagacgtcgcccaacgggaggcttatttttagcgtctcgaaccagtagtcgcccggccaagttgcatgaacaagacgactaaaaataagattttggctagaggagatcacggcggttctttggtggcaacgcttgcagctggcgatggtctctttggtaatgcaggcctctctctcaactaaggtatgtacacgttcctgcagggcagggcaaatagggtgatgatgacggccgcggaggagggagatgagaggggatcagcgagtcatgccaagctgggggaggagggtcagacgagtgggcgagagacgggcagagtgagtgtagtgtacggggacacggtgtttcctctccatcaatttcaatctacatgatgctcggcaggtcatcgcctgctgggttgccagcattcggccgccagcgtgcagccttggcgcaggggacgtgctagccagccctggtgacatagctcgctcggcaatggagctgggtcggatatctgaccagcccggatgaggaaatctgtgtatgtccagcgcaattcttctccatcgagcaactggcgacaccagtccaggacctggtcgatgctgtctgtgggcatggatgtgggcagctgttgggtgggaaaaggcgggcgggtgggcggtcagatgtgatggggatgacagacagataattaaggccccccccccaggcccgcagctagaagcagccctactgcgggcgatggaagggtagattgcacggtcagtggtcaatccagcaatgaatggggtgaggagaagggctgtgaggtgaggcaacgcacatgcagtgcgtcaggtcaggtaacgcaaggcgatgtcatgtacgtctgtctgcatcgagttgcaataaggcggccgaacaaggaaccaccaccaaggtgtcaatgcaccacgggcggacaattaaccacgagcagcatgttccaagcctgaagtgtagccatccctctgctgtagggcatgccaagctggtatggggtcgcggccgctcaagtccaaggtgccgatggactctgccctgccagcttgtgcaccctccccctccccttgacggatccaggggtcagcagaagactttgggggccgtttctgatcagagggcaaagcctcacaaccttcaatgccgctggggcacagcgggccaatcagtgccccaggctacccgaaaccccctgtggctttcaacgctagactggtgctcggcgggggcatcagcggggactcggcgggggggcgccagggctggtgggctccacgaccctcttccgtcccgcgggccagctaaagccagttgggatggcagccgtagtggtacatgcccacccaagtcaccgtgctgggctggagcctcgtggccgtccgccaatctcctcgccagactccctctccaggagggcgccgccttgtactgcctcgtaggcgggcctgtatccggagccgtcagcgcagcactgcagcctgcccaccgcgccgtcgcagtacatggccctctaacgcgggctacttgcccgacaacggccaaagagtcgggcataagggctgcaggttcacgtcgtgcgctcagcatcgtcgacgggtctggccgaccaaccaagtgctgggccttttgtctctctctctctctcgctctctcgctctctctgtcgcccagtgctgctctgcaaaccgacagtcagaacatgccctgtacatgtgccaattacgcgtcgatgagccgctcagcagcaatgtgtctatgtaatatgtctcttcctccagctgcacctctctctttttaagtcgttcactcccggcgcccgtcctctcccccccccccctttccccttctccccttccacctacatatcacaccccacccccaaatagtccagtcaacaggccatcttgcccgatcacatccataataatctgctccccaaagaaccctgcccgagtgagggagtcctagcgtcagattgtggtcggtcctagcttcggcctgcagaaccagtccggcagaccatcctgaatgtcgagcccttgcaccctcgcaaactccacattcttctacagacctgatattactattctcgttaccacctactgccgattccattctaaacccagaccgatcgcagcaattcgcctctttcactcaaggggtgcccagaacaatttgccccaatcttgtccccatcaacggccagtaggacccgactctaaataggaccccggtagggatctttcgctggcaggccaccatcaccgttgcaggcccataatcttccgtgcagcttcttcatccatctgtcctgggtaggctgtgttcaatcccttgcagctcgctagcccgtttgatcttctccaacctcgatcgctcgcccatttatattcaagacggcccccttcagaccagtcggcctggccctttcctgtcccctcgtgttactgacgcacacgcaacactgtttccacaatggacccaaacgagctggcagccatggcaactcctgcgagcacttcggacgccgagtccaccttcaagcgcaagctgtccgtcgagtccgacgagatgggcgccatccagcagagaaagacaaggaagagaatccccagcgagcaatgggagaccaagcgccccgtcatcaccaagctataccaggtcgagaagagatcactcaaggaagtaatggagatcctggagcgcgattatggcttcgaggcaacgtgagtgctcatttctgcccctccacattcagcacgtcccccgccatcacggccatcgctttccatctcgcaatgtgcctttatcatgccactcccatcgccttctctcaccataaatcaccacattcgctttcgcctgccctcttttctaacatctatcaatcagtgtaaaaatgtacaagtcccgtatctggaaatggggcctggacaagaagctcaagagcgatgaggtcttggccatccttctcctgaagcacgagcgggatgcgcagcgcaagccctcgcagttcaccatccgaggtcagcctgttgatctcgataacattaaccgttatgtcaagcgcaaccctctcctcctcacacgtctacgggcgggccaccaacccagtgtccagacctccaacgaggtcagctgcttcactcctcctccaagccccacccgatcgctgccaccgcccggcgagttccatcgcatggatgagttgatgcgcctttttcgtgattatgtcgacggctcacttgcaagctttgcctggacctggcagtatgacgtctcgtgtaccggccgccttcctggagaccgcagcgcggatctgtttgatcgcgtcatggccagcttcgccctggtgaaccgatgcctgaagaagggagacaacatttcggtcaacagtctgctaagcccagcattcgagtccctcaaggagattgtggctgccgagagccccatcttcattatcagaaccgtctgtctcctttggtacctggaacagcaccacaagaacgacctgctgagactggtcctggactacctgggcaaactcatccccatcatgcttgggcagtatcacatgcttgctcggatctggcagattctaggatcgacccactttgcagactacaacgatctatccatgagactgtacgccttgctggttcccatgatggagcaccgcatcggccctgccaatgaactcacaacgatcctctacggtgaccacattgactgcgttttccagcggaagcaatcatccggcgaggttctagagttggcaaccaaataccgagaaaaggtcgataacactggccaacgccactactggctcctcgacctcgttattacgcagacggccgtgctctgcgccaagaaggagagcgagggcgacatcggcggggccatggaccacctccagactctcaaatactaccctcttagcgacgagcaggaggccatggtcgacatccagatgggcaactacagcttccgcctggcggacaataagagcgccattgccgcgtaccgacgagcagcccgcctggccatgaagccaggcggcgacgagcgactgctgaccacctgcctgaccaacctggagacggcactcgccaaggacggctggagctacgacgcggcccgcgtgcgcgacctgcgactgcgacgcatcgagtggttcgccgccgacaccaccgagttcgcggccaagccagcccccctctacgaccagaccgccgcctccttcccggccatgacctctttcagcgaggggctgggcggccagcctggcaacctctcgcggccgggcgatgactcatgggtctggcaggagaccttgggctgcggggacgtggccaaggacatcgtcgccgccagcagcaaccccgtcgaccaccccggcgtgcgagacctgggatatccggtcgtgtctgctgccccctggaccgagggtcccaccgcctgccacccagccatggtcgtcccctccaccgcggtgacatctgtccactacccgagcctgagccccccggcgacgactccatgggtgacgagcgtctatcgatgaaatcatttaacgaaaatacatgaattttttaaagcaaaaaagttgtccttggtctgggacgaggatattcacgacgggaaattttatatctgggaaacattatttcgggttatgtattttagacaataagggtctttcttcttttcaccaactcatctggttggatcttcattttcgggatttgtttcattttttttccaaaggggttctacaggattggaacagcgaatgggaaggcaagtgaaggctggcttcaactatgccaagggatcggtgttttcttcttttttttttctcttcttcttcttcttcttcttttttttttttaactctctctccgttctggccatagtttactctggttccaagaataggacatgattcccccatgataagattatatattattacacgaaagactaccacgtttggaccattccacaacagcttgcgatattttgcgtgcaggactttagtagatccagccctgctaccccaaaattggaacctatatccatcttgcaagaataggggtcggttattattattagccagggggaggggggggcaaaaacctcattgagaactctaattcataacccacccccccctctcccctcgtcctgtcaaccaaagtcctctttccactctcggcaagggaaaggaaagatgggaaagtttcacggcagctctgccggaccgcgggcgggcgtgctagtatcaaaaccccccccgaaacggcagttgaattggcatagggctcgaaacggggtctctggcggccatgataccatacccatacccataacctgtccctcttttttttatttcgccgctgcgagagaggaaaaacccccccccgcaaggggccagatgtgctatctttaacccgcaggaaacttcgcctcccgagctctttatttagagtgagggagggagggaggaggcttagacgaggctccccgaggggggggggggggcaaaacgggccacgagggtcgatccttgcaggttcgtggtccgtgatgtctgcccagttttgacggggtagattcccgctagtgtggtcgggcctgggatgctgtcattgcgtgcaggggaagggttgtgaaactggcatccattttggctactgtccagtatggggtggcgacaggcccgtccagacaagagaagagaggggaaggggtatgggcatgatgaagatgaagagagcccgggaggtgggagaggtatagcctaattcatcattcaccgatccctcgtatccccatctccagtgaacccatagtcaggggggtcagaatgtgtttgaacgacgatagcgagagagcgataaaagagcgcagacaggggagcgattatgccatccagtgtttaaaaaaagagacgcgcgcctgctggatgatgttacatggcagcgtctcacccgcttccgcatgagtggcgcgcgtgtgcatagcgcttctattttgggctgcgtcaacagcgcacacttctgcaggggtcttagtagtctatatggtggtgaggattggaggagcggtacgcgctcaccagcttcggccaactcgctgtccaaataccgggcaacttgagcgatgcggggccataaacggggttcaatatattctgtttttatttgattgcttcaccctagcgagttgcgaggctgtgctggccccttcacaacgcctgcccaagagagagattggcaacgacggccgtcttgtctatattaacgccggctcctggccagccaaggccccgaagacgagcatggcccgtcccctagcgccgcggatttgcagacctgtcagggaaatctccgacccgatctggcgattggggtatccgctgcgccgggggaggggctgcgatgcgtcgtatgccgtatatcgctcgccgacgcagtttcgcatatcggataccttcaaccacgcgtgtacatgtttcaatgcatctgctgtgcctgtagcgtgcgtatacggatttccaccaccgtctcccttctggcctcccaggcgaagagccagttgcggataagttccctcctgcagacctcctgtgaatgatgccactccaggctaatgagatcaaacaccactcagcttgcctgcagcgagagtttggctctcgaaagtctaaatccccgggtttcctgtgctagcccgcccgcgagattttccagaaaatagtctcccacttcccgcaagttgagttggagaatagggctgacgtgtggagaaaggggacgcgtggaaccagcgaggcgagccgctgcacgatgccaggggccgaacggcagcttttctctgccttgcagatggagagaaggggttcgatgcacctgtccgcatctgcgtctgcatgtacagacctgacgataatcgtcgacgtgtacaagcctgcatgaacgtgaagggccagccagcacttctatggcttgctctggactgcgcggatgtacgatacgcaactagcgcctcgagtgttcacaacggtcaagtggcagtcatcgatttgtctattccgcctgttccgccgcacccccgaaggagagatgggtcagccgggcttgtcgtcatcggcatgccgtacccttctccggcttgatcggtctccgtcatagaaacggtcacgagggagtgtaagccttcctagcttggggattccggctcttccgagtattgtccggccggggtccgagggctagccacggggctgagtatcagtccggtccgttgtacgtgtgttgattctgctggcatgtgagatgaataccggcggcgttggagcgcggtcaagctaacggccgaaacctttcagtaatctggatagaagtagcatgcaagcaaggttatctccgtagagagcttcgaggtcgtagctttcgtcttgctagactgcactggcgaacctcgtgtcgtccaatacgacataccctagaccagctaggcagaaacacgagacttgccaaaaccgcgagcgggacaagccattcggtgagagacgttgagcctaaacaaacctcaaactctccaataacatgtcacgaggtcaagtagcgtttcaatcgagctggtgacgtatacatggtagcgcggctgaattacataacttgaggcagtgctgcgcaatacgcaataccgaaaccttagcaacaacagggtttcttcatgtcgaagctgatagtcagctcttacattccatcacaatggaacagttgtattcaattagcgtctgtcagctaagcaccatttttatacagcacaattattagtatcgtgaatccgcgctggtcaccgttccgcgggtaatcgtatggttgcactcgcagtcctatcctcgctgctgtgctacgccgtgcagctgactcggtgacggcagcgaaagggacgataggtcaagcgcatgccaagcgcatgtctcaagtggtcgtcgactactttggattcccatcctgtgctacaacgttgtatttccttgcatacgggattggatcacaccattggggcaccccctggccacggctcactggtaaggcattcagtttcgacaatattagcatgtgttgttcgtcagctcgcttagcaggatcaatggtaagaatttcaaaacctcgtttccattccccggggaaatggtgaataatgaggagagtaatgcgcagggtgggctgattccccgactggcacctgaccagttgaaggaatccagatgccttgatatccgccaagggggtggtgtgtgctggatccagtatcgggtaggaacaatgttgggggctgtcagggatcgcagaaacttggcccaagtctgctagaagccggtcgaataggaggacaatgcctagcgcaatgcgaaaaagtgtcgtggttatggaccttcgtgcgcgaatgggattgattttacttggcattgcgatagaggctcgtttcgggctgcgtatgtgtgcatcataggcgcatggttgtaagtcgcagtgacatgcatccctgagggctatttccccggatttcgcttgggaaaataaccgtaatcccccgagataaaacacaggtcatcgggcccgacgctttttaacgcccaagtagctgagatatgactgctgctgcacgagggacaatcacttgcccgataggcaaccggtgccgcgctggctgggaagactgagatcactgctgcattcggtgtgtttgaaacatagccacggataccgacgagtccgcggccaatgtcaccggatagctaaactcaaagaaagtgtggtggagctaggaggaacgtttggtgcctttctcctctagccttgccggttgccccccaggctaagagatttcacggaatgcgtggccgggggaagctatcggctgctattcagaaactaggtaggtggcttctggacctggagcccattgagtcaagtccaggtcatctgaccacggccaggccccggactagtagtagtaatacggctggcgagcaccatgacgagtcaaataagaccactaatcgatcagtgccgatgcgcggagcgcgacgagggcccgaggagctacggagggcggtggatgtgtgtctctcctggtggtgacttgttgcacttggtgttcttagtcgaggcacggatggacttcctttcgggcattggctcgtcttcgctctggccgcccacatgcactgcctgggttggctattggtcagactcgcacagcgtgtcatgcctggctcatcatcctgcgtctgacgtcgtgcacatctcatggcgtgcattggtacggcccagctcaaggccattccaaaggcgggtgatgctcgcattggtcgtggtgcagacgcagccccccctctcgccttctcacatccgtgggcaggcaggcagaggcatagccgccaggcaagataagggtggactttcggccctccaccccatcaatagcttagctgggtacaccggtcgctgctgtgctgaggcaaaaggataaggtatctcgacgggacttccaaatgtgggtagccaggatggggaattggagccccttggctctgccagtgcaagtcgactttgattagcagcaatctcctcgggggtgatgtacgcctattatcagcagatggcaattagagaggcggctagcgcagcactggccggttctcgcaccacagcgacgaggaatgattcatccgtggcaaggttgcgcaagcatctgtggcgggctgcaggctggggacatgttactgtcctcacggcagacgcagcacctgtcatgggagaggggagggcatcttcccgtcttacatagcaccagcaggacgcctatccctcccccaggatggtaagtgcgatgggggtcaggtacctcagcgtggataccctaggcccaatttgccagtgctactgctacatgcggcgtgccgggacccaggcagggtacatacctacctacagtacatggccggcagccgctctcagcactcgctcctgctgccagcgtgctgaggaatggacgcgagccccggagtcagggcctcaacggcgactcccggctggcattctgtagaaaccgtcagggcccagtctgtctcggatttgaaaatggccattcaattgtgctgcccagcggcaggacaaggctcccaggtaccacccccgatggtggtagcgcgcgctgtgactcgatcgcagtggagggatgtcaagtgggcttggacgcaacgtaatgttcggccatcttccccccacatcagccttaattgtcgactcgataactcgtcccccaagccctcgtataatttactgcgtccgccgtcaatttcttctctcccgccccccaacgaaccgatccagtctgtctggctagctgcgccagccagcccgtccgaaccacccatctggccactgtccgtctgtgtctgtgcaactgcagcatccgtacgccccgccagctggtcccgtgcaggcaccaccaaccgggttctggaactggctgattgattgatccagggtgcgagtccagggctccctccaggttcccccttccagccgtgtgctgcgtgcgacgttccagacgccagcccgtgtagcaccgcattgagaggaggctgcccgcccttgctccagccccggtttttttctcgtttggagccgttgccctttcattcggtccctcgacgtcgtctcgcataatctgtttcgactgacagctatcaccaaactcccaacaagcgcttccacgcccgcgctgggggcctcatcccaccactagacacgcctcatgatacacttatagcgctaggatccaaccgaatacacctcgacctcctcgttgccactgtggcaaaatagatcgtcgacggcacttgctctgtggtgtttcgacaaatccaccttaaccacgacaagcaggcgtcaaccaccctgctcttcatccgccactgatctttaattcggcacattcttgcacgacctcgctcggcctctgctctggctggtgtgtagcagacagcagcctgagcagccacgagtagccgagctttgtggctccattcaaggatgagccttcctgtgactcctcgatcgacgccggcagcgcccccaacagatcacgacaatggcaggcctcaatgccaagcggtaacgcaagacgtgcccagcacgtcgacctcaacttctgcagcgccctatgcagtcttcgaccgcagctcgtcccaccgaccgcatcctctccagttccagtcgacgacgattgcgccttcaccaccattctcaaaccaaaacacgttggacgacactcattccctagacgtcagctcgcctggcagcgatcgcagtgcagatagctcgtcctcgtctcttcggatttccacggaaatctccccgcatcatttcatctctcttcatcgccagggttccttgaccagcggatctggcaattcgtctaccagatcaatcgcgatcaaaaagaagtcatcctttggaaacttccagtcaatttcaagaaccccaagcttgaaggctgcattctcgaatagtttgggcggtcctggtagcgcggcgagcagtctcattcccagcccgatcatttcggcaatgggagacatgtcgccgctacccagccctctccttccagcagattctcctgggccctggagaagattattgggcgcagcttcacccactcctcgaagcagactgaacagccttggcgagggcgacatcatctcgagcagtccttgcgaagccgaggcgatgcagagtacgccacaggcagacctgctctctccagcaggtctccccaagcctgccagcctggctccccaggaacacaagcggcagcatacaaggaataggagcaatagcgagtatattcctattcccgaggggatctcgtttccaaagcggctcatgtctgtctctgggcctcatggcaagctaaatacggcagatgctcacgaagctcacatccgaagggaactcaactacgctgagcagcgaggactcaccccaacggtcaggcagcctcctacccctccgccaagcgagtcatcaaaggattccacggagttgagcaggcccaaggatcttggagagctctttgaggcccgcggacgccatgacaagaagcgccgccgatggagggctctccgatgccttggccagggaacctttagccgagttatgctggccacaagtcagattgttccccaggataatgagtccgacagctcaaactcggagagccagccgaatcgaaagaccctggttgccgtgaaagtgtgcgagcatggtcctcgcggcggtgccagtgaggagcgggttgagatgagcctgaaaagagagctggagatcttgcaggttattcaccatccctcaattgtggacctaaaggcattcagcatcgagccaaccagagctattctggttctctgctactcccctggtggcgatctctttgatgttgccacggcccaccgctcagtgctctccccggcattgatgcggaggatctttgcggaacttgttggtgctctccaatacctccatgacatgaagattgtccaccgtgacgtcaagcttgaaagtgagttgatatccccgagcgaatctggaagagccatctcagttaaccttcgttgcagatgttcttgtcaacctgtcagctcacgagcttggcgacaagtccattgattggcagacctaccccaactccgtcattaccttgacggatctgggtctggcccgtcgtataaacgacgacgaaaagctggagactcgctgcggctccgatgattacgctgcccctgaagttatcatgggccagccgtatgatggacgcgccactgacgcatggtctcttggagttttgctctatgccctgctggagtctcgtctacctttcgatccgcacccagggatgactgatgctcatcgcatgcgcagccgaaccactcaccgcattgcacgtgttgagtggcggtgggtagagtatggcggtgacgataccgacaatgatggtgatgaggccaagttcgaggccaagggcctccttggagcctgtgaaatcacagagggcctgctaaagagggctcgaagccgttggagcttggagaaggtggcctcgaagccatgggtcaaggatgcgattcgcgttgaaggaggggtcaagttttgggaagaggaggaaggggaagagatcctataatgggcacggcgttgggggaaagccgcaaagatcccccgatgaaatacacacgaaacagctcaatatcttctgctaagttgatattgcacttctgggcgccaaatctttcttttgtcggatatatttgggcgatgaaacggcaagagtcactgggaagacgcatatgagaataacgaccaaacaaccaaccttctcttcttacatttgtattctttttcttttttttctttttcaccacactactttcaccagactttgctcttacttgttctttttttctcttcttctcttttattacagttgattatataattattaacgatatcgacgacgcaatgcatttaccgtcgttgatggtgttcaagggggcttagaaataaataaagacagcgctggaacttgtcataccaatatagcatttaaaaattagaattatcgatcgaagacggtcttcgtgggcttttatcatgccaaaaaaattaaaattcaggtccatttcttcacgagcttgtacgtgttttctacgttgtgtatggattctacatttatgtatgaacggtttggtcttggaagatgcttgtgctgcgcgagtctcacgttgttacattatacattggtccccgaggcgagggagggtttggggggcctgtatacagttctccaggttttgaacgcccctcgaaccatgggcgatctcgatgacgcgcagaagaaaccagctgagggtgcgatatatacgagtaggtttcattggttctctcccggggaggggcttggaggcctattttgttctcgaagctctcgagcgggaagaaggaaggccaagcagggcagggcagggcagggcgcatctcgggtgtggcatacgatacaaggcataagagcgatacggtgcatgcaggtagtgtcacatcgttctctgcttctccgcagctgggctacgtgtgagacagctcgccagtatttggagcttggggggggggcgggagtgtgcatactgagggagaaggaaaactacattgagggcgaggaataggcaggtcggtgggggggggcctgggcatcggatcgaaggtttggtggtccttccatgcgtggacccaatttctcggggagggtgagggaagctgaagcgacgttgtaacgtgggaaccgggacaaggggtttggtaatttgcagttgccgatgggtgctatcgggtccttgatatcacggagggggcttagttagagaatgtgatgcagacggtgaagagatagcggaatggaagcgtttaaaaagaaaaccatccgaatagggaagcccgctgaggcaagaggagcagctagagaggtggagtggtgagaggagaagggaggagaggagaggagaggcgaaggcgaaaacaagattgtgagcccagggacagcgctagagcaggcggtgggaggagatgagacaggtcacccgggggatattcttgggggataacttgggaggactagatgatagcctctgggaggaacatgcagagcacagaccagacggcgagctggcccccctcccatttggtctctgctgtttattctaagccctcatttccgtttttaaacattttcgcaagataagagacatgtggcatgcttgaggatggatgccaagaaaggaaggaatcgaagatagagctcgcgttgctggatctggatatcggcatgggtacgggtttgtgtacttctagaacagtcaggcgaagcgcgtatggtggtaacggcaaaatgaccgaggcagataaggtgtcttcaggacagagacctcgcgtggaagtgaattggacttgtcgcggatcatgtctggggaggtttcatctagcaacgggtttcccgctgcttaattgaccaagaccgcctggccgcagcagcttattctgcgaggaatggagcgcattgacggcattagactttgcaatcgcatgcattgaccggtgtaggctccataccttactgatcatttagcagtcagccaagacccgtcgtcatcgagcagacgttgcggcggcggcactaaagagttgtctagccgccatggagttacggagtgtgttttgcacgttctcggtgatgcccgaaacatgttttggccctaaccaaggtcaccatttctctcagccccacggcgcgggcgtaactatcttgggtataaggcgagagcaggaccgacacattcaactaacgcaggaatgtgcatggcgagccagccgctgacgtccgtggctggccatccttttggttctcgtatgcgtgtatgcatcaagttttgctctgtctcacaacgctttcgcggctgggtggaacccgttccgcctgcgcagttgctgtctctctcagtccgctgtggttggaacacgcattccgcgcttatgggtggccggtgtgatatcgatcctcctcgacatatgctgacactcggctgctggcttacatgctgcggctgggcatgtgattgggggatgccggtccgcgatcgtcccagctgtgcctagccaagctcatgatctgcaccgctgctgtcgttggcgagcgtgttccaccaaggctatcgaccaacccgcggcagtcagcgctgctaaggaaaggaggaggtccttaatcagtggtgccgtcgcaggatagtacgcgccaggcgggaggcatccaacacggcgattggcctcgcatcgtatggcctctcctggatttgatattaagtgctgaccctccaggcctctcattgggtgcaaggtgacggcgcggggagggtgtccgagatggcgccagcaaatagatgggcgagaattgttctggaacatgtaccgctcccccgagctggacaccctcgacacctccaagttggttgaggggggtaagtcgtgcatccatctcggcaccatctagggaggtacaatcgcctggcgcgccgtatctacatacatctaggtacgctagctgtgttgttaagcattagcgagttgcccagagagggagctgcagaagctggagaggctgctaatgcagcatgggaggacgcagttcgtcatcgtcgacgcgggggctctctcacttgcccggcaatatggatatgacatgatatggctgaacttggcttctcgcaatggaagtcacaggcagagggcaggtacctctggcaaacgtagtcaggcaggtacttcggcgctggtgggtgggtggctgtcagtatgtcggcgggggtgcgtgagatgggatgcagacgggcgcagtgtctaatattccttcgtaacgagttgtgattgctcccgctgttggctgaaaccgccacggggggtatgatcaacccacgatagagcgagtcggtgcattatgcgctgtggcacagactctcagcgcccccgctcagctgtgccctcggccctgccatgagctgcgctcttctctgccatcaattgattgtcgtcgagagtgctggcaggtcactcactggctttggtggggacgcaccttctccttcaggcacctggtcgcctgcatccgatatcgtgggcacgacccttgtagcccgctatcagagcccatcgccgtgggcaagggcctagcttagtcccaagtagcctgggaattggcaagccaaaccgtttcttcctggccaggtcatgacatctacaatggctttgaggcgccactgacggatgctgcaccacatgcacaggtgcagtatccgcttgctccagcatgcttggcctaccttatattgtagaggtgcacgacatgcttcatattaacggtgcggatcatagcagagtcaaggtatctcgatacctgcaaatcatcaaccgatatggaggagcggggtgtgggttcatgtactgggtactcgatcaccttgatttggcgctacgtaacggatgctgataaggcatgtgcgacctggaactcagttggcccgcggaatcgaatccgagtgtgtcttgaaatcgagacaggtaccagcgaccagagcgcctttggcacatggcctggtgcaagggctctccccagggtccaggccaggtactcgctacctcctgtcgcttgctcgcagctgggcttgggcatgcagcaggcacactggcggccaacacccatcagcagacccgactgctacattcccaagactgcaatttgaatttccactaccagcgtttgaccatcgtgatatgatgctttccagtcattctcagcatccttcttcaccaccatggacgtcgtgacatcacccagaatgtgcagccagcctcaaacacatcgagcccccatctaattacgctgtgcatctcgcttcggcgctggcgcacggtgccacaagcagcagaaggctcaatccatcgtgggctcatccatccatcgtggaaatcctagagctgagcgacctcgcaacagcaccatcgcgacgggcgacatacatgggacgtgcgtgctctctgcccacccaacgcctgcgctttggttcaaggaccttgtccttgccttatctatgcaccagggagcgagcgaccgcaatcacttgttttgctgccagtcccccaactcaacggttcgaatcgactggcgctagccaccctgtccctgaatgtccgggtcccaaagtggacctgggtgccgaggaacttttgctggcgcgccatcttgggacatggccttcttcttggcaatgggaaagacgctgtcaaagcagccaaattgctccgttggccctaccaactcacagtcgtgctgccgttaatctcacatgggccccaaatcttcctaatcgtagcagcagctctcccctgccccccgtaccccttctccaattcgtctctgctgctgtggggtttatgcgcaaggtcctcagttcccatcacccaagtctggggaacgatgacggaatttcggaggtcgcgaggggcgtccgcgacctcagctcgtcgtcttgggggacggcgaggggccactcacacacgctgtagcagcccgcccccaaagcctgtaggtggcagtagggcgtccagtagggcgagggcagggtaataaacggaggcaatgcatgctgtgctagtgcccaatgaggcgttccatcacactacctgcgtgtggtgcgcgattgtgttagggaggcccatggttcgtaggggattggactcgtgaaccaacccccgggctatcgtgcttgctcgcggagcccaccggtcagggctcgctctgggcctggactggacgccagcttgctccttctcctctgctctcctgtcctctcgctgctgcactcctgctcccgctcgatatgcttgctacttatggccagggccccgttggtgcaggcaaggagattattacttcgcccgctgttctggcggcattcctttcccattcctgcgatgcccaggagaaactaacatctcttgagccccggcacttgtcccaggtagccacggcgctccagcactcccgttggaatctacggccaagcaggttagcaccgaagacgaccttacccagggggtcatagtgtgtctctagagccaagacggttggttggcaaacgcaggtaccttaattggccagtggcccgcgagccgtatcaaggtagacccaggtaattcgagcggctctatcgcattctgctggtttttgctttttgcccgttattttccctcccctcctccgtagcgtggtgcagcgtagcgtagcaggtacctactaattcccaccacctgggtaccgcggtacatggccctcggccctggctcccgccacgacacaggtacctcgcgcaggtaccttaccttacctgcgcgctgccattgtgcttcgtcgcgcacctgcatcgaggcacgcttgccagggacagacatggcacacccgcctaacttgctcagggctggtgtcagcggatgctgctgtgattctcagcgtcccgtcgcttatccccgctttcttgactcgcccacccacgcccccgacagcgaaacggtgtcgcccggccccgacaccaattaaccacaggcaggcccagcccagtgtcgccttctccccagcagctgccaacttgacctaactcgacctgacttccgtccggcctctcacctcgatcttcctctttctccccttcccaactttccacttcccatcatctcgacctcgtcatcgtctgggagctctgtttccgacgaccatgggcactttggtgacctgatcgttcgttattacgtcgtcgctaggaatagtcattttcagttgatgggcttcctcgctctctctctcgctccctcacccacttcttttgctctgctgcttcccacacagccagatcgagtaatagcgctcaccactcccgcctggtctaaccataccacatagccgcttcctctctatccctccctctctctctcttggcttcgcatcgccagccgcgacttcagtccgccctcctcccaacgaagaagagtagtaatgaacggctccccggccgcagaatcgcagagttcgcctcgccgtgtcgcattcccagccgtcgtagccaagactgcccctgtggccggccgaacggggcaccacgctgctctgtcggctaggcgctgaaggcagtcgtcgccatccccttcgccatgttcaatcagcgccagtgggagcagctgaatgcttttgccaactcgtttggcggctctgctccttcgcaaagccagccccaggtccaggaatctcgtcccttccacggcggcaatcagcattcaattccccatgcgcatcagcagcagcagcagcagcatcagcagcagccgcaacacaaccataatgcggctgtccaccaccacttccagcagcagcaacagcagcagcagcaacaccacttccaccaccaccaacaccaacagcagcagcaacaaccgcagcagtatggcttctcgggacaggatgaatggtcagggtttggaatgcaggcatctcatgcgccctcggcagcggcctactcgacagagagccacccaagcataaagcgtgaggtcagcatgtctggagatatggactggaccccgagcaccgactacagcaatggcttccagcctgatgggtttggcgcagtccagaatggcggggccatggactttactgacatgggctctttcaacggcaatggagccaatgcgtttgggcacaccaatggagatcagacgggtgcgggcaatcggaatagcggcggtgttggccggctggttgctcattttgagaacaagaacccgagtcctcctcctatgctgccacctcgaccgtcaaattcggtcaccagtcccattgcgaccaataatcatctgcaccatcagaaccatcaggaacagcctacgtcctcctttggtagcttcaatgcatccgcaccaagcaactcttttaacagcaactcgttcaacagcaaccgctttcctggttctatcgagaccaattttggctctttcggcggtcaccagtcgcgtgtgacgagtcccattgccacaagccctcctcctatgaattatggcagtttccaagacgcctctagtgtcaccagcccgaccactaatgctcctgtcggagatccttttgagagtcttgatttcatgaccactaatcaaatgaaccatgggcattccatgacaaccagttctatgattggctcccctgctccaactacacccggcgcaggattgacggctggtactcctggctttgcaatctggcggccccctgactcgcaacacgttcagcagcatcagccaccagccacccatcctcagctccagcagaagattcagacacagaatctgcagcctagtccgaatcccaaaaccccattcagccaagcaaatagccccagtggctatttccgacctcctgttcctactactccgaaaccaccaatgccaattggaaatcagttcatcctggagttgaatcctggctctaaaaccaagggaaaagcaccggccaagccacccaagccccgtgcgccaaagcccgccgcctcttcttatagcacaactgtgaagcaagagccctccaccccccagatgtcagaagtcccttcgacatctaatgggttttcggtaagtttattctatgagtagtgtttgtaagcattttgtttgatcgttatctaacctgcgggattagatgatgagtggtgatccggctgcatctcgacctccgccaatcaaccggccttccagggagcaagttcctgctgaggcttgggagggattcaagaccactatccgggatctctatctcgagcagcggaagccgctcaaagaggtcatgtctatcatggccgataagtacaattttcaggcaacgtaagattggccccttcacagtgacctcaaccaggatttagtgcttacacaggaatacgatagtccaaagatgtacaagactcgcttctcccagtggggttttgtgaagaataacaccgaggacgaagtcaaacgtttgctgtccatgaagttccaacgtgatgctgagggcaaagtatccgagtttgttcgaaatgggaagattgttaatctgggtacttacctgaagcgaaagggagtgacggaatatgatttggtcgacttcgaactccccgccgatcttccttcgcacgttcgctgccggacaccgaccccgccacctgcgccagagtatctcaaatcgcccgatctcttgagagcgcaggaactaattgtcggcaacacgaggaaagccttcttgcagggccgacaggtggaactggagattgagcaccaggttggatgggcttccatcatggtttggggtgcaccttcgagcgatgcgctaactgaagccaacttcttcttcgaggctggcgatgtcgaacaaggcggcaagtctctgatgaatgcttacaaccagctcgaggtcgacttgaggcagctttcgccactgggtatcattgaggtgattcttggaatggtccgaagagacccggggatgatgactgccctgtgcaaatttgtatctgcttcttccatgcagtatcatgagcgagcccacccattgcgaacgatctttacctgcctttacgagatgcagcagaagcacggtgccgttacattgtcggatatgctctgggccagcgcccctctcattgcggatgagctcgaagccatctatggacaccgacatccatatgtggctcgaaccttgatcgatcttgccttggtgtacaatcataaaaacccggagcgcttggaaaaactggttctcgagttacgggttcttcaccgccagatggagcagcaagctggagccgataatggggatctcatgtccctccgctttgcaatagcccagatgctgtacgcagccaacagcgagtcggatgcctcgaagcaatctgcaaacgacctctggaaggagatgaagaagatgaatctggttttccgtgtacgggattcccgcgccaacacgttttgttatcactgccccgtgaaggtggacccctatacgaagcgttgtcgtcggcaatacgactcggtcgtcgaactactcgagaagcatgtgggagttaaggttctaccctactttgaagaagaccaccacctgcatacacacgagtcggactctcaggattcttgggcttccgccatgagccagtctatgagccagcccatgggaggcacgagcagatggggaggattcatctagctgattctgaaggtcttgactctatccttccaagcagctctagattccattttttttcgaacaaaactatacacgacctgagcgcccaaataaacctaccaaagaagcaagatattaaaaatccttttcttgacgcttataccacggagtttactatgttaatggggtggggatatttatctggtcgctgcattttattggagcgagggatgggtcacatcaggtggatattcacgaagcgatctgtattttttccgacggtacagacaatggcgaacggcctggacgattgggtttgatacccagcgaaggttttaatgtgattgcgatacgttcatggctggcgtttgggagcttttcaccgcgacgtatgtatgggacttcgttctttttatcttttttttttttgttatgcggacgcatattttattgtatgattacactacgggataggatatctggcgttggaatggaggcatttagtagaggcacacgagagcagcgagggaggtaaaaggttctctggatttggatatatggagagggcggagtgggagttgggggtgccggggtgttgtctgtcagctggactggaaggttagttgtatatacctttgtgagatcccggagaaagtatatcgaaagaaacttattatctcgtgttcaacggctctcatgcgaattggatttggctaaaagtagttgcaacggtgtgctctttcgtcgtggcgcagcggttcagatggcctattgccattcgccgagccaagtccggagctaaaaatcgccgaactccgacatacactgccttgtctatttttttttctgtgccatgtagctttgataagtatgcgaccatcgtcgagcccacgccatgagggtacccgccacaagccaatgcctgcgacaagccgtgcaccgagtcgctccccagaggagatggtttacatgcgatcgtttgattcagggtgagctttgactatgacggccttgcgcaatgtgttccaccgctgaccccagacccatctcccagagcatgacgtcgtcctcctccgccagcgaggcgacaagcgagcaaaatggaagctgacgccggcgctgcgcgacgacgagtcccaccggatcaagctcagctacggcgcccacgtccgcgcgcaggacctgattggcaagcggtacctcgacaccgtgaccgactcggccggccgcgaggtggccatccacgatgccagcatggccagctacattgtcaacagcgagcgcatggccacgcccatctacccgcaggactgcagcgtcatcgtgtccatgctggacctcaaccccgagcggcccggggagaacgacgacgggccggacggcgacggcgaggtgttcgaggtgtttgaggcggggacgggcatggggagcctgacgatgcacatcgccagggcgctccacgcggccaacccgcccttgaggaaggatctgagggatgcggtcgccacggcgagtctcgagaggagggcgccggcgccgggtggagaggcggtggccgatgccgagattgagacatccggcgccgagcagcctgccgaatccgtccccagggatgagagcgaggtcttgccatccaccgactccgagctggcgacgcctgaaccgtccagccccgacatcgagagcaagccggaccaacaaccccccatccagaccatgaccctctcccgcctcgacgtcgcccccgacatcgccagcgacctcgccgactggtcctcctcccgccgcgcagtcctccacaccctcgaccgcaacccgtcccacgcccgcgcggcgtacaagctcctccgccgcttccgccgcgccatctacctcccctcggtcgacttccacatcggctccatcagcgactacctgactccccgactcgcctcctcctccgggaaacccttcctctcccgcgccgtcctcgacctcccttccccagagtccttcgccgaccccgtcgtccgcgccctgaaacccaacggcctcctcgtcgtcttcaacccgagcatctcccagatcgcagactttgcgaagtgggccgtcaccacgcgccagcccctccgcctcgagcggaccgccgagctgccaaactccttcctcgtcgcggccgacgagccgaccgccaacgactgcggcggcgggcggccgtgggatgtgcgcaccgtcgtgcccaggaacgccgcgtccgagggggagattgtgcaggtgatgcggccgagggttggggatcgggttgtcggtggtgggtttgttgccgtgtttaggcggttgaagccgatggatggcgttgaggaggaagagaaagtggaagaggagaaggtggaagaggagtgatgaaagctgggtgatgttggtgtatactatttattgtacgatatgagcccatgtatgtattatagatcgggaaatcatgataaacctggagagactgtggcttaaaataatgattggctgaataatgccctcttttaagaacaagatcactcgagcatttcacagaagcaagtcatcagaaaatgtaaactcaagagaaaacgctcgctattcatataatgcaacgcagacaatacataaaaaactaaaatcaggatccatgtgtgagggtatcaatgatgcaaacatagaatgctatcctgatcatcgttgagtcatttcctttcgttacgcccttattttccactccagaggccatccctttccatcgcaaaattgaattgggttaatgacctgccattgtgccgcgccagtaggctggcgaggctcccattaggaattagtatcctttttccgtcccaaagaaaacgtctcgcatgtcgtgacggtgaatttcgtgtatccaaagtagtaataataatgacgatgggtgtcccagaaatccagtcgtcctccgtcctgcggctcggtgaaagtgtagtatgttggtggtgaatcgaatgaagtactgatgccggcaggtaaatcgttttcctgtatatttcgaaccattctttgtttgggcgcgagccctgtaaccatgtagcatgctgatgatgcagataacaaaaatgaaaatgagtaaatgaataaatatatgcttgtaaatatatatgccggttggtttgaaccggttagatgctggaaactcggtccggagcacggccgcagcataccatgagcttcaggctggttccaagttgctcgcactctttgaggagctgcttgtcgttccagatagttgcggtggctgttgggtcgatggcggtttcgtagcagcgcgtgtaccaccaccgcccaacacgggccaccattttggtgatgctctcatccgcagtagagctgttgtcactcatcatctccgagaggctgggttggctcttcttggttttcttatctgtgcctatcttctcatcgctgacatggacgccagcgttgactttggagatgggactggccacaggaacaccaacccgagcagccctgatgttcgaaaaacccgctttcccgatttggcgaacgatcagatctgcagttgacgccaggttcatttcacagtctgattcatggattcgctccttcaactgtcggactgcccttcggccgagctgacccatgttgttgagatcgaagtcaaggatggagagctcaagatagccacccggcttcagaacacgtcgtgcctcgctgaggatgttgcggtagtgagactctggagcagcgatagggaaacggtagaccacagcagtgaagctttggggagcaaaggggaacttgtccaatgcggaggtgtactggatctggtggtgattggggggactaagagggaaacttgaggacgagtttcgaaactccgctggcagaggcgcgcgcggagacaggttgaagaagctcgcctgtgggtatgtctctgcggcgtaaaatgaccagtcatcgttgccgaggccatcgatcaccagaacaccatggcgctggagagacccagtcttgtttatgagttcatggcgaacgtcactgaaaagaacgtgcccgaaagtgagccacttgctgacagtcatagaaccaacacgcagattgacctgagacagaggcgacccatcatcagcagcggaaccgaagctggaatcagaatttcgctctggtacaggtgacaggctgtggcgaaccattttgtcacttgctctcctatctaaaggcaaagcttcactctcttcctcttgagcagggaattcctcagatggaagttcggggctgtcatgaggttgaaatgcagctcggatcctctccgtcatatcagcgctgtaacaacttgagtttgttggtgcaagcgaatacgttgactgctggcggccgtccattatgattgtgggtgactccatcggcttatcccggagggcattggctttgtgaggcgacaaggggaaaggggccgctcttggagagattatcgacgaaggaaccctgatagcgttgtcttcgccttctccaagaagatcattgtattcatcccatatctcatcctccgtaggcggattattgggttgcggaatgacggcggtggaatcattgaacgaacatgcaccggagctagaacttgtgccaactgtgcactcggagttcttccgcggagagaatcggatgaattctctttcttggcttccagacgcgggatagtttttggctgctgattcagctagcgaggcgattgacataacctcgtccgtggtcaaggcattgattgctggctcagaagggggctctattggcgtttccaggcccgtagccacaaagtttggatccaaatcgaccgaatcctgtgggctgagggtcatgctacggcggaaagggcgagaaaagctgtgaggagacagaggagggtcatgacgatggctcaccaccctgggtattcttccgacttgcttcaagcggcttggacggccagagctgagagatgacgaggctccggctggaggaagtccggtgtcgtagtctgacatgaaagccggagccggcaagggaaggtcgccatatgcctctttcggtgaagggggttccaaaactagggaggtcgaagattgagtaaaaacctcggcggtccgaaggatatcccggatgtctgtggcctcagaattgtctttctctggagagtctagcattgcataaaaggcaacggacttgttttgaacaggctcaagcgcaggaggctttgagtcggccttctttgctggactttgtgatcgaccaaataagttccacttgcgtggtgatcgagaccgttttgccggcctctttgaagctgcgaagccgacatcgctatcgtgagagatctcgcgctgtagctccccgaacgactcgtcagacatgatgctggtgtcaaaactggtcatgggagacggcgccaaggcgcttgtaattatcggctgaggaagactgatggggttatccggggatactctgagcttatgagcagatcgacgatatgcaagtgtaggccgcacgcttccactgtcagaatcgctgctctcggaagggcgtcgagatcttgggccaagctgaggcacccgtaggctatttggcacatctggccgagaaatcgtggcgtcccctggccccgaaaccgagtcaaaactcttctggctcagagcaagactctggttgctctcagttcgagaaagctctgagctcgtattgcggttttcaattatctcgcctcctgcaatcaccaccgggttcattctatcagcaaagaaagagtctgcgcttcccagactgtcctgagacgtttggttatccgaaactgttctcgagtggctgccacttccactacgacggcggatattccctactctcccataaccttcgtggccagtaccggcaactgggcccttgcgagcaatcttggggcgtttgtccgtctcctttttggttgattgagcattcgaatcggcgccactttgggcagccttcttacgcccaaggccaaagaaggggaatctgaatgagctcccactagatgtaggagcactggaggacttcagtgagtcagctgtgtctggtcgtgtcttgcccttggttggtatattgataggcttgggcgcggaactgatttcgcgagacgtgggcaactgtgaggtggaggcgttcctagtctttgagtgcgactggacaccctcagaggtactccctcgtctctcgccggggagagacgaagacgaaagattgctatggatgattcgaacagggcttcgaagctgggattgaaaatctggtgttccgtctcggctgggtcgccgaggagcgacaggcggcttatttggcgaagtgacggcgcgtggaagcgatgggatatttgatgtgttgcgcgaagtagaggggggcttcacatttgactttcgtggtggcgtttgaagagcctcgtctccatcttctgagtctcggcgaaaaccttgcgatgattttcttggaggaggactcggcggaggcggaggtaaacgccgcttttgtttcttctccttgttattcctctctccatccttgacagtggagcttgaagaggatgaattcaaagactctcttacagctgctagaccttgagggtcgaccgcgtcggtctcgttcccactaatccatcggctcactggaggtcttgtctggtttgggctgaactggcggtctttgaatacgttggcccggtttggaatggtgatcccgggtgagtgtgaggaaatcgaagtgggcgtcgtttcgcggctgtaccatcctggcccaggagatcctgaaaacttagttgacggacttgcactcaattgactactgcttcctgaaaatggcaggctaactggcgtaggtggtggtaagtcgtgagttgatagcttgtaagggatatcagcgtatgcatcggagggtggattgtatgcatgataattgcgatatctgtcaagctccgggtagataactggcgattgggttaggccttccataggttcaggagactgcatcaggtcaacctcggcagtttggtaatccgattgctgaacaaaagaagtgtaaggtgaggcatccatgggttcgtcaaaccgagctgcgggccgaagtggttccatggtttgatgttcctgaaaggcctttgccggagtctgggataccaaggactttttccgtcgcaaaacattcctaggaggcctttggctactttcataagatcttgtagaggctgatgaagtggatccgctttgagtgtgtgaggtagaggtcgcagacgcattagtactctcagaaccccaagacgttgactgtcttgctggtgagagcttgggtgttgcttgtggcctggcttgtggtcgagttgaggttggctgaggaacccggctagggattcgagacgtggatgtctgggaaggtgtgcgattgatactgctcgacccaggttcgccttgggactttgttgaccggttcacaggccgaggaaggccgcccatggatttcgcatctgccagacgctgtgctcggccctcgtttggccgagcaggcaatcccatcctaagggacgacgacattatgatccaaaaattccttgatcgcttggcggtcccaccatcaccgtgttgtcctcaataccatgatccaatccaacaatatctgggcctaggaacgtcgtcactcagtcaacaacacacttaacccaaggaagccagacgaagccagacgaaggcaacagtgactcctgtcaatccaaatcaacatactattttttgtagttggtcgaccttcgtctgggcgcacaatgatacaagaacgcggtcggttttggatgggttgcggccggcttctatataataaaagagtgggtaagcaaatattcccccaactagcttgaggctgaaagtatttccaagagagatgtgacaggaaaggttcgaaagttccagctgaaacgagttgaggaaatttacccaagtcgggagggaggtgatagttgggcatatgtgatattgtttgcgccgtgaaagaacgatgggtgtggaggggttgttgcatggaggacgggggctaaaatcgttgttgaaggtacaagtaagcttgtagcgacgaactagcccgagtcgagttggctctagatgatggagggtgggatggcgaaaagagtccgcgtctaaaactgaagatttggcgcaggggagggggatcggacagtacctttgctattgtatcccgtgtgacgggggctcgcctggaggtgacagatgccgctggtcagtagtggcgactgggaccggccgcgggaagagagaacagaggagaaaagaatgggaacagggggatgtggtaatacgagtcccggaaagaatattagaatggtgaatatatagaataaacgaggagtagttttaacatgaggccgattgaagaaagaaggggggagggaatcaagacagataacaaaagagatctatggcaagtgctactatttaggagatgttggcttggccactggcagggagtcaagacgagaagtgaagtattcccccggacaccaccaggtatgggtacttccgctacggcgagtaagagcttaggcggcatttagattggctgcatgcgttagggtatggcgatgcaacgcgcggtgtctggcgagcgatgagcaagctcaacgacggcggtccccggtgtaggcctcacaattgggccgtctacttgggacagggttgcgttagtcgacattgtagggcgagtgatccatccaggccatccgtggagaacggacccaacagcgctgtggagcaggcatgcaaaagtgtgcggatcaggatgtctgcggccgacagcagctcgcgcacgcctgggaggtgcagaatgaaccatccaacagtataacgcctggcgggactgcggcttcgattgggcgcagaaccctgacgggatatgcagtctgcccttggtcgggagccgatgtcgccccagcattggccctggcaaaagcgttggtggggttgccgaatggttgcattttttctcgctgcgcctcttgtgaggcagagacgaccacacatgcgatgctattcccctttggacgggtcgacgatcagaccatttgtcggtagtttggaaatctttctatctcagctcagtaggaatctgcgactgggagacttcccagcatcgattgcccactcgactggactgcacagaccagccatggacggggtggatcgtcttaggctcgagccgtcaacggtaggtggactcgatgccatcctgtattgtccgtgcttcatagtttaacatcctgttctgtacactactggcactctattccttggccgtcgtctcgtcgcctcacgcaatggttggtcggcggcgtgcccaggattggccaagggtttttccggtgttctctcgcgtacaaacggctgctggtctcggcttcacgcgacaccaaccgtcagaaccacgaggcgcacgaggacgagaaaaaccccccaggacatgtgctgcgcgtgtgatatgtcgcatgcaccgaaacagaagggtttccagttcaagactaggttgcccagtcgttgcttgtcacgatgttggcgatccaacgcttccgtagattgcatatgtgtgtcttagacattgtctttctgcagcttctccgagaggccaatctctgccgtacctggctgcaagtgagcccaagaggcaggatcagcaccgacccaccaacccacacgtcttgcccggcgcttacctcactcaagtcacctatctgctgccgtgatggggtgggcgagcgggtggcttccaagttcacgtcgccattgcaaccacaaatcgaggaaaggaatacgaggacggcatcgatcgaaaactcgagcggccgaagccaagcagcagacactgcagtcaaaccagactatgggacagtcggtcgtcaagatgcggccctgcccgcgcaatcttagaaaagatgagcagctgcgagcagggtgcagctatcacacacgggaggatgggatacctgcctcagccgctaaaaatcgcgcttgtcctcgaggacttggattgacgatcgccagtgcgaaagcgaccggccaacatatcacccatgagcgggtaggcggctaatactgacccctgtccacggcgcagactcattggaggacatttacttagctaggaagattgatggtgtgcgaaggaatcaagagaggcaaggtctcgtaatttgatacgcgcagggcaagagctaaagttagtcgcgagttgagacctgcctctttgctgcacctttcctttggagggcaggtacactcgaggcatctttgccgcccgctgaaggcaggtggcagccatcgctgcctccatgagctcaccagtgcgtcctggcattttctcaggctctgattcgcctgcgccacccagccccagaacccgctaagctcgcgccttctgatttgccaggctcgctgaatttgtaccaatcacacccccggctatgtctcggttacaccctcctggtcggctggggaagacgggccccactaattacaccacttagaggtcccctactaccctgcctctaacaagaagcttacgcagttgcgaccctccggtccatgtctcgcctgttccgtgcagtcggagacatccatatcctcactgccaacggccagatagccatatgtacaagtaatctcggtatattactcagcggcgatctggtctgttttcgactgacgtacatacatgcgagcaattgaaggccatgaccaaggccctcgccaaccaggctaatggagcacgcaaggtgtcttgtgactcagagtctctaggccgacaaccgttgaaagttggatgttggccagctacaccagtggcgacattgttggctgccaaggccagcccaaccgttaaacaatggacctctaatttttcctttgttttccccctattttaagctcttggctggtcaagctcatcgtcaaaatagccaaactattcgatgtatcagccctacagctcagccactcactcaccgatgcgttgttcttcggtcctggggagaactaatggcgggtgttggggcgccctcaactcgccgaaccttgacaagctgaacgacggtcaagccagtcatgcatatgcagtcatttcttacgcagaccttatcgtaccaatgacagtattgttggaaacttgctggttcttgcgggttggggatgatagatttgtgggtcaaggcagactccgccacacgagagccgcctctcccactgacgtggcacaaaaaccgtggcggtgtcggcactgagcgacggtgtggtcagtggcgcaccacttcccgtttgcttctacggaaaataaaaaaccgaattactgagatcatcaatcgatgacgccaaatccctgcaaagtcactcgtctggcaagtcaagtaccagtacgaagctgtccagagccctggcgtgcgcagccatcgctttgcagctctctctgaccgccatatgccatcagtcaccgggctccgggacgaaatggaaacacctcctggatagcagccaggagaacaaaactttgatattgggacccttggaagattggaaatagttcaagactcctttccaccaggcccctctgcccctcccatcctgcaacgggcagtttcgatcgcagcattgtgctctccaatcgcagcgagaagcaggcatagtgacaagggtcctgctcgagtgcgcaggggtttctggcatatgattggctcctcacctctctggtcaagccgccatcaagagaacggctggcgaataacacggaacacccacagacaacgacaccatctctcggagggtcatacatcgacgaccactcacgtgtttttaaccgagacacggtcctatcttgaagattcattcgtttccaaattccagttgaggcttgccttatttgtgctgaccaagacctatgggggtccgtatcagggcccccaacctacttcaaagagccgtcacccctcccctggcgtctcaaccattatctagcttgcagccgatatggaagagattcttctccaatcatggcgcttctatgcaggtttttggtactgcggggttggcccccagggtgagtaccagggtttatcaagattcgactcatgtattggggatcactcatgcacgtatgctcaggtgagtagtcaggtaggtcagtcgccacagctccggtatcctaccaatctcggtcacaagactcccgcatcatcccttcgagtctcaaaatgttgccctgaggagcgctttgtttggcccccgatcttttatcgctcctacaagtgtaagcagcagtacagctgaaggttctagcgggagcgcccggccgcgattctaatttgccgctcaactgcactccgcgctagagtcatgtcctctcatgttgttttgcttcacaaatgacgacattcaggagctcacatggactgaattgactcagctcaacctgcaagcatttcagaccgccggccgcctgcgggatgcatgatcacggcccttttcacgacccttttcaggtaactccagctccagaccatccacagttaagcgccgccattctcaagctatttctctactggcccgaaacttgtaaatatgggtaaccccaggcggctcggcacggggcttgctgagcggcggtgtccgagtgatgctattagcgcctccagctcctgctcatatcgaagatcgctgaccctttgacccgatcctttatcatttgcgtgatattgcgctcgacgccgaatgttccaagcggcggccgccaaggccagggtttccaagtcaggtcgctgtctccggcagacttcaacgttctgactggatagcatatgccttcctgacctgctgattagaggctatatcttagagctgtcggctttatgtcatgccaagatcgggctaagaagaatcaagggtattcttttcgctgctagatattctagggaccctcgtgcttatttgcctcttctaattcgccccagacatctgatgtttgataggtgtgacatgtttgtgttcatataaccgcccatctctctaccctagatgtacatcaatgttggtgaggcaacattgaggatggagaatgtagatcaacttgagaaagaagaggcatgattttatatgattcaagacaagcctgtttctacggtaaaaattaccatgtaataatagaccgtagtgtttaccatcctcatctcgctgatggatttaaaaaggtacgagggggcatgccatgacttttgctagtgagcctccaaatatacctcaatagtccataaaatgagggaagtgctcagcgacctaggtcgcaggccctggttattagaacttccaacctccttgcttgtagatatcgacatgatgcgatggttcctagcgctgtaggcctatgaacaacagccccaggaacaagacgtctagcaacatgtgttcaacaccacacgcggacatagtcgctcttttgcaacacagcaacaagatgccgaacagagcgatgggcaagagtgccgcgttgagttgcaccaccttgttatcccttcctggcacagcagagtgtacgctcatcttggtcatttgccatgcttgtttagtataatgaagtatcgaggagccataacattctcaatgcctgatcccttccgaaggtatgatagaatgaactcaatgtaggtagaatcaagtgaagaaacttcgtagtgttgtgatattcaaacaatgggagtgtttcttttccggtgtcggtagatgcgggcatcacaaaacgaagtgacagtttgtattggggtttctgttctcaaaccaaggccctttctggtacgaaccaaggtcaaatgtgatgtctttgctctgacgttgatgacccttgacatccagtagatcctaagtctagggtatccaagcagcttttctggctgatgcctccagatgaacactcacatcaaatgggtaggaggtaatctcttgaacttcagaaccattacaaatcctttgtctcctacgaacatggaagatggtccagagttccatcgtccagagggttgaaaggaggaacgcagcttggaattcaccctcaattctcacactgcttggagtagaaggattgctgcctcgaagtcctggtttgaagggcaagaagaacacagcattcgaatcacatgaatggaaacggttcaaattttctgttgatcataggcatagttgcgaagcattttcaattttcatatttttttctcgcttagaagccccaacgcccagcacccagtttccgctgacttaaaataccatgtatgctatcctcatatcattttgggtttctttttgtaccatccctccccgcagctgagtcctcatccaacgactttacaaaatagaaaggagacgaagtaagacaaaaggagagcgaaatcggcaaaagacttagtattagctcattatccttccatgtcgtctaggacgaagcgaatctcgcagctcgcttctccgccttggctttctccgctgggtcactcaagatgtttgacctgggcttggcaccggcattgctgctgccctcgttgccgccctggcggccacctctccggcgcccgcccctgcgatcgaggctctggcgcttgttcgctcttccgttggccttgccgtcgttctcacggccgcggccgcgcttcaggggtcgctcgggcagggccgagtccaggccggcggggatctctttatcatcgaggccaaatcgcttagcgcggtccgaaagcttcttattgtcatcgtcctcctcgataccgaatcgcttcgcccgctcagcgcgcttcttggcttcggcgtcagcggagctggaagcaagtccaattgcgtacgagggcttgggcgcctctgcagcagcttcggcgccctcagcggcgggctcggcactgtcctcggcagcgggctcctctttgggagcctcggcggcgggagctgtagactcggtggcgggggccgccttggtggctggagcctcatcgtcggagtaggtgatctcatcctccttgggttcttctgcgcaggggttaatatgcggggatgagaatgggttgagcgtggcgttgtgctcaccttgctccttggggtcggtcttcttctctggctcgggctgctttgcttcttcttcagccttcttctggtcgttctcggcgagtcgcgcaaccaagtcggccttgttgcctgtttgcgacagtcccttctcagccaggagcttcttcagctccggcaccttcaatgaggtgtattctgccattgtatcaaagctcgggagttggctggtgtgtgatggaggagggagaggtagatgatgcaatgacgcgcaaattggcgatcgcagagtgggcgcgtagctggcgctttgggtcgcgagagacggatgatgattccgcgatgatcagggataaaaaagtgatggagatagtcgccgtgaggtcttccttgtgcgctttggatggggagatattatgaatagaaagggagggtacgagcagagcctgaacgtgatgtccagttgaggtcgacctcagtcccaagctctgtcgcccagcaggagtaggttattgccagccttttgtttttggaaaaggggacctcttgtgtacctggagcaccgtggggctcattacggtattgtaaagtacccaataagtatctcccagcggcgcgcacggatcacccctaccacatgctggtctcaggtcagctccctgaaagctgctgaatcagcagtcgttcattaaattccattgtgctgtggctgacaatgcacccgagttctgtggctgttccgagactccatcagcagaactcagacggatggtgctccaagacctactattgacctattgtgtgattttttgtgtgctattgtcccagccattgacagaggcacgtaattgtagctgccagatatggcggttcttcccaaaaaagtataaggcacccctttctggaattggctggatggagtcttcgaggcctcaaatcatgatgaggctggtgaagagcgagttcgttgttatatgacgactcaaatgctgcaaggtatttcatttgattgagaacaaatgcaaactaaaccgtgaaagagatccttgcacattattgtgctatatgttggaaatgcagcttccatcctgtaggaggaaaacgtacgtttctaggcaactgccctggatggctggataacttcgtccgatgctgcggcaatgatccggcttgtcaatggatctctcagggtcttgccagactccgcagcacacttaatttagcactcgaggccgccagcagaaaggattcctcacaataagcactgcggtctcggcctcatctccccgttccccactgcaatacgggcactggccttctaagttataggggtccccctgccaagccacaccgcgtgcttctgcagttgggcgctggaataggctcgctgcaaactctaattccgactgacagcaagagtcgagtcgcccatcaagcaatcgtcatggacatcagtttcgtcaccgccaggccattctccttccgacactccttgcttcttgcctcgtcgctctccgtggagtagatatacactcctatatcgtgtatctatatctacgtccctcgttgcttggccctcatcctattagacaccaatccagtcccgccttgttgcaacgtcatcccatttgtcttggcaggtcgatctctccagctctcttccgactttgagagcaacccttccgacctcaactgcctccgcatcttctcgccatcccaccaacgaacgcacccacgtgatagatattactgggcacccggccatcagagctgtgggaagatgccctttgcgccgacaccagcccatctacggtttggccctcgatttgcctgtcgcatagcacatccgtccggcgcccgtccttgcaatacagtgttagggacttctcccgctgtggtagcccccgcggcaatttcctcttcatcatgactcggcgcatcgtgagtctcgggcgatcatactccgtactgagatgcaagagactctgctaaccgtggctcgccacctctcaggtacggacggcgctgcagctggccacattgatcacctttacgttcctcgtcgtctacatcctcgacagcaaataccgagtgcttccgaacaaaatccatggctatatgccctcgcaccaccctggcctcgtcgtaacagatgtaacgattgcaaaatgtacctccttaaacccgttttcttcatgcgatctcgatacgagtaaatggcaccgaatcgataaggaactatacctcggcaaatcatggaccggtagagcatacctccacgtcgctcgcaagcatgaggaggaacttacctccgacgaccacgtcgtaatggacatttccgtagggagactaaacccgacgtcaaaaaaggatgatgatctatgggagcagcgcccgggggggttgtggatcaagcgctccgcgagtaggggatccagcgattcgaagaaggccattactgatgtggatgtcctttttggggatgatgccactgaggcacgtgaaggttgggcgatcacggggacgccttttctgcttggtggttcgccagtccacagcgtccaccttaccgtgagaagaggcacccctgcggagatcaagaaacccaagccgagagtcaaggacaatggacgctttaagattctgcagattgcagatctacatcttagcactggggttggagtgtgccgcgagcctgtcccagacggctataatggcgggccatgcgaagctgacccgaggacattggacttcgtgtcgaagatcctcgatgatgagaaacctgatcttgtgattttgagtggcgaccaagtgaacggagacacagcgccggacgctcaaacggtaggatcaagctcatcccggtgtatgaaacactcgactaaccttcgttttcttagcctattttcaagtttgctagtcttttgatcaagcgcaagatcccctatgcggccatttttggaaaccatgatgacgaggggaccctctctcgcgaggctcagatggctattatggaaaatctcccatactcactatctttgactggaccagccgacattgcaggagtaggaaactactacattgaggtgctggcgaaaggctcttctgaccactcggccctgacaatctatcttttggattcccacgcttacactcccgatgagcgtaactaccctggctatgattggattaagccgaaccagatcgagtggttcaagaagaccgcaggtggcctcaaagacaagcacagggaatatacgcacaaacacatggacattgcctttattcacatccccctgaccgagtatgccgatcctaagcttccccgactagggaactggaccgagggcgtgacggcccccgtattcaattctggattccgggatgcccttgttgaagagggcatcctcatggttagcgctggccagtaagtcttggacatgtcatatgacgtggtttgatccttgatctgtcgactaaccctagaattagcgatcattgcaatgactattgctctatctcgcttgaaggcgaggaggaagatcctgcactatggatgtgttatggaggcggtgttggctttggcggctacgctggctacgacgaatacgtgcgccggctgcgactgttcgagattgatttcaacgaggctcgaatcttcacctggaagaggctggaacatggcgacactgagtctcgaattgaccaccagatgctcgtcgagagaggaaagccccactacgagaaaccgaagaagccactcatcccagaggctggcgaggaagacaccgagagcacgtgaacgagggatctgaatcacgtccattcagcacacgcatgcagttctccaacgcagtgctcttcgaattatcattagcgggcgaacgggaaatgaaacgattgcttttggctttttccggctttggaaacctgtgccctcctacatttagcggaatccaaccctacgcttcagagtattttttttttagcaagtatcatccacgcccgagagctcgtgcatgttacgccttggaaagagaggggttatgcagcggcggaactgcactccggagtcagagacgaccctatctattacctgtgtataaagcaacgccatggtttggccatccacatatcacctgcctacttgaattagcatcatttgaaaccatactgggtgtttatccggaatgtttggtatattattaggagtataaaaaacgtatatcttgatgcgcttgttatttcgaatgttattgctatttctgtctctaatcatgcctcattaacacgaacgcgaaccttcgctacctatgtactgaataatgatggcgtaaaaaaaactcaacatgttacccgcttgctctggctaaaaagggggatatctccaaaagaacaaacaaatgtgcaaaaaaaaaaaagaaatatcaaacactccatgaagcacttttgttttcgtggttgggaccagctcctacaccgtgcccctccgccgcccatcccggaacaggagcatcagatcatcgaccttgaccccccgaccctcctcgaagaactcctcgttctcgtacatctcctgcagcttcgacgccgtggccagcacctccctctccgagtacacgtccctggcggcgcgcttgatgctgacgacctcgaggtacagccgctcggcctcctcaaaggccgtgcggcggcgggtctcgtgcatgacgtcctcgtccctggattttggcttgatggtgcgcgacgacgagggggagggaatatcctcctggagggcgcggccgtgccagcgggagctgagggccatgttctcgagggtggtggtgtagagcgggtgggcgcggttgagcgagcgggacatgatgtcgagggcccggcggtactttttggccgccgcctcgtagtggccgcggaggtcgtcgatgacggcgagtttctggatcgcgtgcgcggtggaggggtggtcggcgccgagggagcgggtcttgatctccacgctctgcttgtagaggctctcggcgtcgtcgatggcgttgttggcgcgggagatgttggcgaggtcctcgagggcctcgagggcgatggggtgggcgtgcccgaagaggttcttgtaggagatgaagacgcggcggtatagggcctgggcttcctcgaacctgccgagctgctcgagggtgacggccagcctttggactgtgttgaccgttgagatgtctgtaggtcccagtgtttgctcttgctcatgctcgagggtttcgtattggctctcggcatcgtctagctctccctgtgcagcagacgtggaggctcttgccatggcgacgcggaacccgagtgccttatcgatggaaagaaggtcgagatcgaggaggatatcctgactccgctgaaactctcccatctggttcaggagggtggctagcgacagggaggtttggatcctgtctatggggctcaacgccttgttttctctcagtgatagctcaaagcatccgatggcttgctctgttgccccttgcgtcatgcagacatttcccagcacctcccatgcaatcacttgattgtctggggatatctccaacgcagtggcccagtcatcgtaacaggttttggcatgtggagccatgatgcgcccgaagtcatggatctcgggcaaggtttcggaatccgactccttcctgcgaataccgtcgacacatacagtgcaggcgattctggcgtgatcgacttgtccctcctgggtgagtgaccgacgaacatgattacgagcttcagactcaaggatgaacgagtcgaagctggatgagctggaggactgcgatgacgagtcagttggggaggacggcgtctggatgaagttctcgttcagcaaatgctgaaagacatcattgagatggtcgagatcttgaaacactggtgtttgttagagacgaggagaatgaggtagtaggtcgggggccttacatttgacatcagggaagttagatgaaaggtttgttgacgcttgctttagtaggtcggtggtgaacagagccacgggaatcacagaatttgacagcatggcactgatacccaggatggttgtagtgactggggattggtcgatatttgatccagggaaacttaaaggaaactttgcgtcaagtcttttgcggtatttgctgatggttatgtccctatgtcggattgttgacgataacatggcgatactctgggggtggtaaccaagatgcttaacgacatcctttgctgcttcaactaaaccaatcatcagccatattttctctcattggagggaatgaagtcacggcattaaacctacgttcttcagggttattggccatctcgtttccaagtgtggacttgaccaactcgatagcttcagcctcggtcatgacgggaacctctagctcagtaccccacgggcaacaagttttgtctcttgatgtcaagataatcctcccagacaacgtgagaggtatgaaatcgaagatgtcgaatgtagcgtcgacattatccaagataagtagccagccacggttctcggggcgcatcagccagtccttcactgcacgtacaactgctttgacggtcggggtatcaagctctaagatgcttttcactttgagcatttcaccaattccagtcaagccgagatcattctctacacggtctctgggcgccttcttggagtagtggcagacaagagattcggcaaactcgagatagcttgccacaacagtttcccagctctcggcccacacccagatgacgaaggatatatcgctcctgtgtatttctgcatagtgttttgcaagtgtcgtcttccctgtaccggctgggccccagagagtggcgatgctaagttgcagcttgtcgatctcatttttcggcctgagaattgtatcaagctgctcaagcaagtcttgccgacctaccacgatacctggttcaccaggaatcttggttgggatggagaagtcctctgttggaaaatccaacgggggagccacagcgagattgaagactttgtgtttttcatccaacagccctgatacgccagcactatttatcatttcacggaacctgctgatgaatgcttcataattcgaatcacgcccatggaatttaatgaggtcagagtgtgtcgcattaaggccgatttgatcgccgtcggatcccgtgatggcatcggtctttttcacaacgaagctatcctcagacttcttggtctcgtggaatgagagacggggtaagttcgtcataatagccttgaacgcctcgagttgtttttctagccactcgctgtcgctttcattgagctcgaatgagttcatggacaaagaccttctgctgtacttggtgtcctcgttcaggccagaggtcgttctgcggatgacgtgagcaagtggcgatggcgacaatggttttccaggtgagagtgtcccgaagaaagcaatcccgcaagtagacagctcgatgtccttgagttccacgtcggcagcctcgctggatatgatgagggcgcgcttgacgatccagccgccgagactgtgggcaatgaagaatatcggtctcttctctgtgccgtccttgcatctctgggccccgagctctttgaccatgtcgagagcgcgaccgtacaggacatttcggatgacataacgaaaactcccaccatcagaaatatacccgtaggtcatgatgcgggcatttgggacatccttggcgagaagctcctggagccatgacttgtgactcttggactggctgggatcaacggtgacccatgacttgaagccctcgctccccaggccatgaacggcgacaatgctagaaatgaactatttagtacgcgggctgagatgatttgaaatggagagacgaggggagaagagcgcactcaatatcggcattcttggggtcgcggacaatgcgtaagccgcagtattcgccatcagctctgtgtctagagagtgaccctttgacccgatggaccaaccctctgatgggctccagcgcgtcatccatccgcggctgcgaaacgaaatttcacccaaaggaaagcttcagatgacgatagaccagaagtccagcggagcgagagcgtggtgtgttgatgacaagcgcaagtggctgtggcatgacctgaatctggatgtggttctagctgggcgcttaggtaacctgattgctacaccatcaaccgcagcactggcataagtgacagaaaaatcaagacaccaaaagtttgccctgcttcatctttggagctacatgggtattttcgatgattgcaggatgataatacatgaatagctagataatacactcgctattatcgagttatatgacatagatgatataataagcacaataatcacgaccatgttcggtgcatattactcttctaatactttggccgaggtacaacagaaggcccaatctagaataattacatatcattgctgcggcacagagagtattgtgaagtagcatgttaatattaataataataactacagtcagctaaagtatattagggaccctccccccctccccctcctcctccccccccctccccaatcattcctcgctggacacgaagcggcggcgggccctcccccactcaggggccggggcggccggcatacaagggcagaatgcccccgtgatcgggcccgtgggcccgatcgcgcctgctcactttgaatgtgacaatacacaaaataatgagctgcccccacgctggtatggcattcataatggccattatggccccaagccgagtgaagtggagggtggcggcggcggtttgttcgggccaaaggattagaggagtaacatgcaccgaacatatggagacgaccttgattgacaatcacaagcctggtgggtgtctagattattcctatttatccttgcaaagtaagactgccatgcccagattcagattgctttagggtcttcgctgaacaatttccaaagatgtctcagatgctgcgctagctacagcagaagctatgcgcctcatatagctcagggctgtaatattctctgctgatgtatacccatctgctgagcggtgttgctccatgtttgaaagagtgctattcgatacctcaatgattgctgtagctgtgatcatagctgcttctgtctgtttttcaacgagagcaatatttgcagtagtggttatagcttcaacagttctgtgacgggttcttagaatcacctcatctccctctccctgaggttgagatatagaagagccttccttagtgatagctatggcggcttcaacacagatgtggcgaatggcagaggagagggccaaaatattacccaaaccaccaacagtgctcgctagcctatcatcaactcgccccataactgtattcaccgtccggagtatctcaatctcttgggattcagacaggctggaattctttagcgaggtttcgatcccataaggtggcgggggtgtagaaggatctagtcgtgcgtgcgcgggagaatctcgtcgcgagcgggttgggggatcttgtcgagtgtgtgtgggagaatctcgtcgcgagcgagtaggaggatcttgtcgtgtgtgtgtgggagactctcgtcgcgagagagtaggaggctcttgtagagtgtgtgtgggagaaacttgtcgcgagagagtaggatgatatgggtttaagaccacgtagtcagaccctcgagggttaaacacgtagtaagcaaacgggacctccatcatgaatgcctttgatgatagatcgtattttatcccttaatattccaaggaatttcggatgagccttttggctaacgtgtgtattcttataagagtgacttttggatgtttgtgttttagtctcgaaggcctagctggctgtagtggtgatattgtggcaagtgtcgttggattggatggatcaagtagcttttcttattaccctcggacgaaggaagctttaaataggaatccaacaagggaaccctctccttttgatttcaaattttagtgaatctcctagcattcactccaaaacttaactgtagctaaggtagccttagtggcgttctattgtcgggctgggcggacctaaatctaagttgacctttggctagcatggagtatttcgtgttgctaatgcttcgggcgcgcgccgtcctgttgccaccctgcccaggccacagaagcgagacaactatgggccatacgcaacttagccaccttgacgcagttctttcttttcgttctttctaggcgtagatgtggaccaactgtagccgagcgacagaagaattgagacaccaagggtcagttctgttgcagttttagagtagtggtgcggatcaccaactcggtacttgagactgatataattaggtaaatgaagtgataatattctttgtattatagacttgtatggttcttttaatgtctctccggttattgttgtttgcgctctacttataattgctcatccacctggtgccttatttctgtcacccaccgccaccccttcaaggcagatcggttggaactgcgccgctcggtggagccagaacaacggacacgccctgctgtttgactcgaaacatgtatcatatatgtgcgtatggcataaatcaattgaattatctagtgttagcagcgcttgctgaatggtggcaacagggtggagttgttgggcgactatgtagcatgtctcttcaagaaatggccgtggctttagatatcaccttgaatcatcaaccgcattaagaccttcaaccacaccagagccctcgatcccaccaagaacttcaaccactcgatgcagacagaatcaagcagaacatcagagaagcgtgtggcctatttgtcgttattaaaggctcgaaggtctatttgctacatcaaactgctagagaatttcttgtcaaaccattatcttcggcgcctgtggatgataatcagccacggcatcactccctgtgtccgatggagtctaacaggatccttgcggagatctgtatctggtaccttctcttggttgattttcagaagatatacatggctcctgattttgaacaagcaaatgaccaatatccattactaaattatgcctcgagtaactgggttgttcatttccaacaggtacgaatgaagaggtgcgacaggttaatttcttctgccttgaaactctgctctcccttgtacgaatgaagaggtgcgacaggttaatttcttctgccttgaaactctgctctcccttccagaagggaaatcctatttggttcgaaatatactggaaagaaaaccaacagaagaaaggacggcgtgttcctccgtcaggttttgatgctttgatgatggcatcgtattttggcctggagagagtagtcgaggagtttcttgctgtgaaatgtctcaagacctggttcgagacttcgctcaggatctcttcccgagatatcagctttggaagatcagcactgtcgtgggccacttgcaatgggcataccatggggtgcgtggtaaaactgcttttacaccaagttccaaaggcggaggtaaaattgagagactggttcccaggtttatctacgtgtgttaacgcaaaagatggaaatgggatagccccgttgtcaatcgcccttggctacggccatcctgaaattgccggccaactgataaagaaaggagccaagattgaagccaaggataactatcagaggacatcgctagcacttgctgctcgttggggctacagagttatcacccagctcttactagagaagggagctgatattaaaactagggataagcatcagatgacaccgctagcaatcgctactgcgtggggctatagagatatcatccagctgttgctggagaagggagctgatattgaagctagggatgaggatcagaggacaccactagcaattgctactgttcggggctatatgaagcagaatatagacattattcagctcttactagaaaatggagctgatattgaagctagggataaggatcagatgacaccgctagcacttgctgctgcttatggttatattggacagaatacggatacaattcagctattactagagaagggggctgatattaaggctagggacaaggatcagatgacaccactagaagttgcgaccgctttgggccatagagatatgatccaactgctgttggaaaaggggataggaactgaacgaccctcgaggtaatatcaactgcccgctgagaggctgccgaaaagaacacagcttagcacgatgctggaaactccgtcgctggcatagttggtaaaagctcaacgttttgattcattagaaagaaaatctgttttatggtcggccattttcacgattgcttccatcatgtttactataaccacctccaggaattcatgtttgcttcccaatattttctttcataacgatgtcgcaagggtgttgtgatactgtgaaaccgagaccagcctctagataccggttttaattgataatatacataaacgaagaccagtcctcgtttcagaaactgaaatgaacatacggtgcctagcatgccactcttaaagtttcatcatcaacccaacagtgtgtattctggatactctagtactttcagcgtttgtgtgatccctgccccaaacacgaatatatctctggtatattaatcagtgatgatgacgctcctaccaactgtcatctatgagctcgctacgatgcatggagatctcaattggcccgacattgctctgtatcccacccgctcatatcaatgtgactctggccacgtcgggttcgggttatgggagacttttcttgaacggaccaatgaaacggctggagggttgaaatgagggggaaaatggggagttacatttgattgggaatctcatcgtctcagccacttcgatccatgcaactgccatccatgacgtgagattttgcctgagcgcctgagtcctgccgcctttgatggttcgctccggtcccccgcactagctgtggccgcacactggtttctcttcctcacatcttctctgctttcgccaatttctttccttcagtccttcagccctaatcgcacattctggaagtagcctcgtgcactggagtgggataatggatcccctctcagtagctgccagcgtggcaggactggttagtttggcggatgtggtatttcgaacagcaacaaagtatcgaaaagaggtgaaagcctctcagaaagaagtaggtgatcttctcaatgaggtgaaaaatacttctcttctccttcacaatttgtctctcatagcctacgatctggagagcagcacctcccccggccagacgagaggcccgaatctcaagctagagcatcttaatgattgccgaaagattctacgccgacttgagagcgggctgattggggcgaaagaaggcttcgagctgccatctcgtctcgacaggctgcaggctcgtttaaaatggcccttctctgcttcagaaatgagagaaatggttgagtcgctacgaaatcaacagaggtttataaatacatctctcacggcagattcaatcacgcaactcacggcatgtctttctttgcaacaggatacagcgggccaagtcaaagaccttcaagccacaacgagccagatccttgaattccagacaacgatccatcttgatgaacgcaggagccgggtccttgatttttttctcaaagcaaaccctcagtcggaattcgaaatgagtaaaaagctgcgacatccacttacaggcttgtggcttacagaaggggaggattttcaccgctggtacaacgatcctggggcgaggatatggctcaacggcatcccgggagcgggaaaatcagtgatagccggggcgatcatcaccgaatgttttcttcaaaaccaatcaaaccctggacgcgctgttgcatacttttactgcacttatagagattcgagaacgttctcagcgtcgaatatcttgtcatctattgccgcacaacttgcccgacaagacgagaaggcatacgaattgctagaggcgtattacaacgagctacgtctgcgggactctcttccaaagaacccaactaccaagggtctgcgggaggtcctgagcaccatgtctatactcttcaaccgggtgtatattattattgatgggcttgatgaatgcgacaacgaagttgaggaaaatgtccaatgcctcctcgcacttgggcgtgatagcaacataaagaaacaagtcaacatagctctcttaagcagagacgaggtcttcattcgagaaaatttcgaaattgagttccatgttgtcgaaatagaagcccatactgaagatattcaactatatgtggcttcagaattggagcagcggatcggttctggaagactcaagattagggatatgagtcttcggggccatattatagcagaaattgtcgaaggatcgaaaggaatgtgagtaaattacctattttcgatccatctctactagaaccaatcactcagacacatgttaggttccgatgggtggcttgtcaacttgattacatgtgtgagcttctgacggatggagctaggcgcaaggctttgaatcaacttccaccaactctgccggcaacctacgagcgcatcctgttgaaggtggatgctcatagcgagcaagtgaaatccctcgtgaaaaacagccttcttctcatcgcatatagagaatatggtctcgaatctcgcatgatctgcgaggcagtctctacttcttctcactgcactagattggatgccgatgaaatagttgaagagaaagaaatcttgagatgggttggaagtttggtacggagatccaacgacgggaaccattttgaattcgcacatttcacagtgcaagagtttcttgagaatatttgccccagccaccttactctgagcgcatacggcgtgtctcgtgatagatttcacagatacatgacttctgtctgcataaaatatttaaccctggagaatttcataccttgtagcccgcagcccacccctaaggatatttggaatcttctacagttaagaaactcgcgacccttttatgaattttctaccatttggtgggtaattaatctgcattaccgctcagatgtgaccgaggataatacatattctcaactccaggcattattcaaacctcccaaaacaggcaaattttgtctttgggcaattgagcttatgaggcactgctacaccaagcccattggcgggcttctcgagccacgcggcgatttcttcaaccgtgaagatgcggcggtctacatatcagctctgctcaggccagactttactccgttgcatatgtcagccgccttgggatttccacgacttacaaaggatatgatcaacatgggttgtagcccgaacgtgaccagcaggtttggaacccccttgcattgcgctgttgggggccttaccgtattttctgatgctactaatgtgaaggatcttcaaaaagtagctgacaaattggatctactgaatattcaagcaagacgtgatacagttcagctacttctcaatgctggcgttagcccaattcctagatttcaatcaatctttaggtcttcaggcatactcggactttctgccatctttcccctcctcccgctgggacactttgaaattatcgtcgatcttcttcgcgcaggggctgttgttgaagacgatgacctggaggtcttctctgccacctatgaccagtttattgaatggtcagaagccgaggaaaggcagagactgaatgatggcccaattctaaaagatttgatcgaagcccttggtgccccaactgcgagtgacggggctcgatttcagttattctccatgacagtacaatttatcgcagagctggaaaatttaacaacggatgaaatacctcaagaggtatctattgacaaagaaaacgtcgtctctatcccctccataattcgcaacaatgatgtttctcaattaagtcgacttctccaagacggaaatttagactggttggaaactacgatattagacgacggaggagaagggttaaagccaatccatttggccacacgcgaaagatccctagacgttttgggtctgatacttgagagcggatgcgatgtcaacagcttaatggacgacggacaagcggcggcaaatatatgctgggaagataaacagggggaacatctcaagctcctgttaaagtacggggcttctaccaccatcaaaggacgtgatggcacatccttatggcacgctgctgccatagaagactctgttatcatcatgaaaatgttggttcaaagtgagcagcgggataaagggctacgaatgatgtccccggaagggcagactccaatctgcgctgctatctctgcaggttgtctccgttctgctcacgttctgctgccctactgcagcacaaaagaatgctggcaatcgcacaaatcaatatttcgcgatgccacagcgatgggatcgtttatcatcctcaagaagctcgtcgaggttggtgttgacttggacggcgttgacagtacaggttcgccgctgcattttgtaccccgaaacccagaccaagagtgtgtgaacctactttcctcactcttcgaactgaatcagaggtcgtctgtcaaccaaagaacgccatttgaacaatatatttctcgcaccttaggccaaggggcctacgccaacccccagatatacaagctccttcttccacaagaggcgctgattcacactacggaatcaagtcgtgtttggacaaacatatgtgaaatcgttgctctacctaaggacacatataaaatcggcatttcttggggaagtgaattgctgcaacatctcatcgatatgaaggttttggaattgtttgagacagaacggcattcgtcaggtgtggtccctctctgcgatgcatttttgcgtacactggcggaaccagacttcatagaggatccccagaatggatgcttacgcatagatgggaaatttggtatactgcctggcatctgctgggagtatttctcagctatgctcatggtagttgttgagaaaacaacgctaccaacggccattatagccgagcccaccgttctaacagccttaaagcatgctatcgtacaaaatgatttgcctctggtcagattacttctacaaaacggcgcagagcctcatactgaagtggacgggctgagtgcattcgaaatagcctgtctcggtagcctatccaacgatttatttacctgtatcatagagcactcacaggctaaatatcttcaaaaagcaaacaaggccagacgggggcgcgggccacttcactatactttttctctaggttggctttcacaacacgaagagggtattcgtgtgcaaaatttacgcagcctacttcaagtcatagaagattgcgatacaccgaactcggagcaggatggaaccccgttgttctaccacgttatgagaggctctataagcacagctgaggttcttgtcgaggcgggcgcaaacccatggaaaatttgtgcttctacagggctcaactcggtgatggcggcagtcgagcaaggattcacatggggaaccatcgagatgattacgcagaatgagacctacccaccgcagtggaaatacgccctaaaacatggggaaacacttctacacatcgccgcaagggtcggcaactgtgattgcctggaagtactactgaacaaaggcattgccggtcactcgcaaactctcgacaatgacaatagcacacctatgcattatgcagcagagtacggccacactgaagccattcgtatccttgcccaaaggggaggagatgctaatgcgaaaacaatctacggcttcacaccgctgcacgtcgcagtgaaacatggtcaaacaagtaccgtgcgagtcttacttgagatgggagccaagcaatttgaatgttcgaatggatgtaccccgctagcgtacgcatacaccgtgggcaatcttgatgttatcgagatgctcactactgaagccaacgttgttcaatcagcgggtctggtcacgaaaccaaaggcactacttgcgctagcaagtgctttacgcgattccgtgatgaacgacgatcatgtttcatgcgagaggctcaagaatctaggttgtccactcgacgtagatgttgagttgtcggggcagtgcatgactcccctgatgcttgcgatgtgtcaatggaaaagcccagagctgataaattggctcattgaaaacggctgcctgatatctaccgtctatgaacccccaataaattatgaccacttttctgttctagatgcagcgattatggattccgtttatgtcggctttctcccgcagctgatcaacgcctttgttgaagagggaggcgatttactcagcctgccatataatattctcttcaaggcaattgattatcgagaacacggtgcactgaacattctgcttgaggaagattttgaagatgtcgccacaatcaatacgtcagcgtgagtagcaagttgatacaccactattgaacgtcaagctaactggcaagcttcacttgcccccctgagaaactcagccatgaggcccggtcagcgatccttcgtcttgtcaataagcgcgacgaaacagaattttatgaagagactcccctcataaaagcagtttcatcaagagctgttgatgctgtggagcttttgatacaagccggggcggacgtcgattttgtggacggttcttggggaaacacagtcttgcactttgcaacattcgaggaatccgtagatatagtacggctgatccttgattccggctgcctcgttaatgtgcgagatatgaagcagagaacggccctcgattatgccttcagttatggtaacttggatattgcccgcctactgatccaagctggtgctcaagtatcaacagagagcatcgcactgttcggtcatcgccggtccttggctcacctattcaaccacgacgatttccggacttcacggtctttggatctacaatatcccctacacatcccaattacaatgaaaggctatgagatatccaacataacggcaaatattcccatcctaagtcgatatataggcgatgctaaattatcaactgttttaaattttaattcttctgggaagcacagcgttctatgccaagcaaccatgctgggcctaatgcaagaagttgaattgttggttgattttggagccgacattaactatctatgtgaggatcacggtactcccctgacagcggctgctcgtttccagcggttgaaattgttcaagtacctttttcgaaacggcgcaagcatgtgccatggctccaaaccgctatcgactgttctttcgaatgctaatggcaaaattcatccaactattttgcattgggtactcgtcgctcagcatactgagcaacgccggatcacgtatgaacaattggatatgggcgagaacatcactggccgttgggcaggggtgaagacagccgcaatacgtgtgaaatgggagtggaagagatgtcgcttcgactcctcgttcgaatatgcttgtcgactgcaatacgtaaagaaatcgcttcggggcaaagttgtcagtcccttggaggtaaaactatagtctgagaactgatctgattatatcgcgagaggcaggcctagatctgagaaccaatcaatatggtcactaatgtcgcagatagattgactgccagattaaagcagagaagcacacaggtagtcgagtggtgagaaaccggaggcagtgggataatcgtatgccagtccggcatgaaccaaccaccacatacatatgttctgacaataaacctcatgttggacaatagcaagagaaatatctgtaatcgcacgtttattgtactcgtgcaaaatagataatattaaatcattctaaggtaggatgggccagctacatagaaaacgactccaagcaaccacctccttctctaccaacgaggctccctagcaggttttttctttttgggcttgatcggctcgatcttcggtgcaggagcatatttgtcataaaatggccgtatttctggaaaaaggaggtcccattccgaaggccattgctcatcaaccgtgatgcactggcggagtgggctggtatagccgcgagacttcatgagtgcagccacgtttccgtcagattcccgaagactccaccgctcatcctggacgcgatgcgatttgcgttctttgtcgagacttgagttgaggtactggctgaacctttcgatgttgtgaatcaattggcccagcttggcgagctgtgtggccgagatttcctccacttttggctggccatggaggcaagaatcggaatcaccatttcgcgtaaagtcgcagctgtttccgtccgcgccggggccgatgcaggagccttcttcggacgaagagtaatatgagtaagacgaggacgaacaagaagatctcggggtgggaagtgtcaggatggggtgtagctctaggaaatcgcttaggagtgttggtgcggcttgggagtcggtctgagcacactgattgagaacccagtgttctgtcgcgccgttcttatagagcagtagcgaggcggtatcctggctgtgtgcctctattctcataatgctcgttgtgagatcgcaaagtactgtttcctcccacggggtagagagaagatttggtgttgcgatatgttcctgcttctccttgacctccactgtcgttgtatcgccgcctagttgagaacccacgtcagaatcctcgaatcccgaggagtccggtgagtcacttccatcgccaatcttgtgtccgtctatcagttccgtatcgaggggatcaggttcaggcagtggtagttgaggtgcggaagcgatgatcgtatcccaagatgtgcactcagccgcccgctggcgaatccttcgtaggcaatccaaaatcgtatcaaccctccgagacagaagagatcgggcctcgatggagaattttgccgtccgtctcgtcctccattcgcatggcatggtgtaagggtgagaagttggttgggtgtctggttagatcggcttagcaacagcctctttgtaatcttggtgccggcaagttgtgtatcgctgaaccattcacgacataagtctgagggagcaaagatgttgggcagagggaaataagggtggaaggatgagaatgttgagggtacacggctgaacaaaagcaaagtttctggagtgtgtgggtgtgtgactgaataggaagatcacacgaaagagaagaaggaagaaaggagcttaggaagggagagaaatcatttaggcttctgctgtgagagtaccaaggagagtccgtagttagagagtttgggtgccctagtacattaggcataagcgtactttgagtgagtagtaggtcttatagcagactactagtagagaagcacgggcttggaggtacattgatcaacgagatgacttcaaaggggcgggagaagaggcagaaagaggcacatactttttaatacagcagccagtggcctgcaagccagcctccaggcccctgttgtggggggcaagagccagtaaaacattcgtgaatcactgcctgcctgcgtcgatcaatgtagggcatatcaatgaacgcattgtctgttgttcacgtcatgccaccacactggagggcacccagagcagaggcgcactcgacgacttgaatggtgggtttggctgcaacaagtagagatggacgagtgcgagaggaacacgctgcattgcataaagccactcggagcacgtatcattgaggcccacggcgtgtgtgagattcagggagcgatggacggggtaggggaatgcgaggctcacgtgttgctatagagccctgtaacgcagagcagagcagaagaaagggcagcagccaagcctagcatctagtcagtaacttctaaccccgagagttgagtaacaatgccatggaaggcccggcactcatgaagcaaacagttacttgcatgatgggaccaaaaccaggcagatggggcaagagcagtgaatcacgaccaacaacaataacatttgcatcctgccatttcagtccaggcagcaataagcatgcataataaaacacaaatactacccaatgtgcgtattcggcagcaggcggagtgggtgagttgattaatgcatcttcgctaaagactggagaaacttccgccctccttattcgtggatcttttcttatgcatctacatcacatttttctgtactccaaccaagccgccacgtttggtactgtcgcgagttagaagtcggcaggaatggacgggcttcgatccgtgtttcacgaagagacaccgagagagaccagaggaatgcaagctgcggcaagtgatggcgacatgtgagtgttgccaaagcttgagctcaccaaacgaagtgaaataattgagtacttgaatttctaatcgccaaagtgtcgaatatccatccatggtgatgaaaagcgcagattatcccgatgattccgaaaagaaaagaaataggaccacgcctcatgtgaagctaccctccacattccagctatccaagatcgcagtgacggccagtcaccaaagtcatcccccgttcgtcacaagtcaaagtctacaagagtgaatacaacaagatgccaagcccatcacgaacttcgttcggtgcgagcctgctttgccaagcacacccatcagaccatcgcaccacatccatcatcatcaaactcggtcgcctattgcccatcgcccagtcaatagaatcaatctgaaagaggccgcctgtcctcaatcaacgccaactacgaggggatcttggttgcaatatagcaatacgcattatagctgtttcatttcggcagaaggttgttggctgcggtattgaatgcagttcaatccacaccagagcctcgacatattgtcatggtggccactctcccagtgctccttcttttttcctatggaagcatcctaaaactcacactcatactcacacgcagccttgaattgtcgggactaccttacaatcacaggtgagcaccccatagattgtaccgacccgaaatgttaccagactacccaagtatctattgtggcgttcacaccatctcaataaccttctcttgtgcgaccagctctctggcgatattcagtattcataagcgagcgtcgcggatccagcttggcccttcgtcgcacccttttatgccatcagtcaactatcagggaaatcccggaataatcggctcagatgggaggcttggctcagtgggatatgttgcatgtcggagaattccatcccagcctggactccatcggacgacttcaacatctgctacacaaacataattgtcccagcagcggattccagatacattgaatgatcgccggaacctggatcatccaaacattcgagcattttcttccatcctctcgacgatagatcttcgccgcacgccgaattactcagtaagccaaggcgtgaataccaaccccgaggcttgccctccaccggcttgagaatgagtgcaacggcgccctctgtctcgtccaatggcttcgtcgccatccacacggggaggcaatataccgacgtagatgtggcagtgatgttctcgtctgggaaaagtgccccctctactgtttccccttggatacgaagctgcaaccttccactctcatctctagcggacgggtcatggataccaagctctgcctgaaacacgctgctttttaaccgaaggtagccatctaccacctcccccgtaacatcaatgtttgatagtggtgttacgctggcttcctcaatctcaatgaggacacgcccacgcaacggtgagtgccaaaagctcacgtcctcctctgcctcaatagaagcccacgaccaagatggtgccctgtaattctcaggccggcaacttcgcccaccagcaatatggatatgccacaacagattagaggggaggttgccctcccacaggcctgcaagataccggtctttcagagcgctacccatgcgtttggcgagaccgctgatggcaacaagcttatccgtatcctttgtgatcttagtattccaatacatatgaatcatccggcgccacttgtcgtagtagtctttccggctgaggttgggctcttgcagatgcgtaagccacgcttgggaagcatcaatgtcgaggtgtttcacaaaactataattcaggcttttcaagtatattggaagaccatctggatacatttcacatgattcccgctcgcggcattcccacaccagttggttgcatgtgaaatgcaacgcccgcggtggcagtattctttcttgtagcacccagccgcgtcggtgcagtggctcaaacaccgtgtgtttgtcccagaaaacccgagaaaaaatatagaaggcctctggctctattccgtcccacgaggtgcgaactgcgtagtgcagcaactcaccttgatctctgctccggaagagactctagtggctgttcctgcatgccgtggccatcacgttgagtgtgctgttgctgtaaacttcacccatgagcgccgcctccttctgccagtcttgcaaggaatcctgagtaatacagagggaatcgatccaaagatagcgtattccaagcctcctagcaactaaaatggcatctctgaatgtctgaggaagactggcggtttcaatcttcttctaaaactgggccagggcatcagtcgtaagtttaatgatactttgtccaccccagcaatgactgagagttgcgtaatcttctttgatgctctcttttgcagtcacgattaaccgcaaaccacctcggcgggagttcaagtcgagcaggcgagtgggaaaatacgagaaagatctgcgggatatgttgcacctggcgtgtttttctaggcagtcacggtaccattttcgggcctggttgaacgacccttcggatccagtatgaggagtataagtatagcatgccatgacattgccacttggacggccaagagctcgaaagtctaaagagagacggaatttaatcgccatttgagccttgtacttcaagtagaattgggtgacgtttttgcgtaccttcagtcgagaacaagtgagtctcccagacaaaccgttcgagaccatggtcaccccccagagatctttccacagcatagtagtagatgctgatttccagcgtatatgtatatagcttcgacgaatttttcgacaaaagacggtaggaaaagggctcctgtccgacctgcgtcaacagaaaaccaagctcgtccttgcgcagagcagctcgcgcccgagtacagatgacgcatccagagttcgccgcggcttcgaaggatgcggcggaggagtggtggacagggcctcgatcgctactgatcgaggggtctttgagctgctgctggccggtgaagatcgacatacactgtgcgcacagccttttttcgtcctcctggtcagtcagcatcatgagttagcccgatgagtatcctggtgtgcctcgctggtggccaagattgcggtattatcctcaatttagacatgccgcgtcaggccatcacaagactagctccatgttttcacgtgagatcaatctcgatcaaaccccctagataagcatgaatgaagaggatgctcccatctgttgagatcatgcctagagtatgcatatttgggggagctgagctggacatgagttatcccaagttgtacccacacaagcaaaatctcacctgggtgtaacaacagccaataattatgggcataacatatgccaggttgttcttataaattgtacgctcaaagaagcgcatttcaagccaaatgcctgtcccatgcaagtgttacatacatgtattctagcccggtaactaggtgtcgctgaaattaaaacacccaaacattaagctacttgttttcgaatctgtgactagtattctcagattattgagtggcaatgataaatacataaaagatattgttgctttatttcggtttgtactacagacagttcctattcattgcagaaagtggtctattcatagcccctcttccattgtatatctcacttctcctgtcgcctacttgccttagatgccagtgtatctgtctaactgtctcagggctctttccacgaagccttaaactgtctcgccgggaagtgaaccataatacctcgtggcgctcgtcatacatggagttccatcgggatacgacagcttctcgggagatcgggtcctgtgctctcctcgtaaacgaaaactatatgtgatagggccagccgcaagcctcatatagctccttgttctaccccatggcttgagttttcttatccgcatccatactcttcctcctatcccggagctcttctttcgggactttgtccttatcaagatgatcccctcacatattaaacgtcaatagcaagcatattatcttttccattttatttattaaccttcatagcctctttctgctgttaattcgacgtctgaccatgcatgtttgtgccggaattaggcatccaactcataaatacttctcgactcctaccacatactgtcttaaagacctttgccaaaatgttctccagatggagaggctctcctacttcgacgccagcaactgtagcatatccaaacagtaatcgaggacctaagactactactttcatcagctaacatggtatagattggagccgatctcacctggacaacctcagcaaaattgtcgtgcgcaagtacgacctccgtatcattccattggtcttccttgcctacactatattctggctcgaccgttccaacattgccctcgcccgggtcaacgggctggagcaggacctgggactcctaaactcccagttcaatgcgtcactcgccgttttcttcgccttttacatcctcctaaatatcccggctaacatcctcttgcgcagaatcgggggaggcacctttctccctgccctgatggttgcatggggaacagccactctctgctcgggcttcgttaccaactttgccggcctctgcgcctcgagagccgcagtcggcgccgctgaagctggttttcttggcggtgttctcctctggctcggcttcttctacaccaacgatgagatcgtgtcccggatcggcattctcctcagtagcatgccgctctccggatcattgggtggtctcctggctggtggcctctcacgaatccaggccggctcctactctcggtggccatggatcttcttcatcgagggggccctgaccgtcgtggtcggcatcattgcgtactttgtcatgcccgatactccagctacggcttctttcctcacgggcgaggagaagatcgccgccaaagcccgcatgatcctactagatcaccggtcctttgcccggcgcatcgccttcgtaccaagcaacagcagtagcaattccgatatcccaaagtcacgacgcaacagcacgcacccagaagcagcccgaaacgaaacagtgaccaccatcaggttttccacaaccctcgacatacccgccaccatcatcggcgcaagctcaaccgaccggattcacaagtcaacctggagacgcgcagtgcttcaccccatcaccctgttcatgaccgtcggctgcttcttcaccgtcgagtccatatacgcctacaacctcttcgtgcccaccctcctcgtcgagatgggcttcaccggcgtcaggaacccgctcatgaccgtgccccccaacctcttcgccttcctatacaccatctgcataacccaatactcgcagcgctcccgccgggtcgccctacctctcatggtctcagcctgcctagccacactgggcttcctcttcctcctcatcggcagcttcgcaggcggcaccgacgacgcgcgggggaagcccatcatcgtgaagcccctgcagtacgcgggcacgttcctcgccggcgcgggcgtctcggcctcgacccccctcgccatgagctggctgtgcgtcaacgccaacccgcactacgtccgcgccatctccctcggcttcgtcatcggcgtgggtaactttgcttcgttcctcgccagctacgcttacatcaagaccagcgctccacggtacgtccccctttccttgataagatgagctgttgataatggagaactgattgttcataacgctaggtacgtcgaaggccattctatcaatatcgctttcaacgcgtgtcttctccttgtaggtgcggcgaatctctggtggatgcgcagggaaaatgcccgtcgggaacggggagatcgggatcaccggctgcaagatctaccacccggcgtatccaggacggagcacgagatgcttctggggtgggatcatccacgattccggttccatatgtgattggggtctgcaggggtgagaactgccgtcaaagaagatacacatgtatcgtatttcctttgcgacgtaatttgctgttggatttcaggtggagatgccaggagattggagcctcgtattaaccttcccgtaatttgatgtccaaggcaaagaggcatatcataatctttgtatccattgaatcttttctacataacttcttctctagcctgtcccttccggtgacgaaaccataacctaatccaaagaataacacctatcggccatgttttttcctaacgtctcatgcaacgccaatcctcccccctctatataacatacgagagcacctagggggaggaagcaggtctatcataatgcaaacaaacagagtatccataatccgaaaggaatatcgaacaagacctacaaaaaaacacacaggaagaatgagggacagcggagcaggctagatgctcaccaatctgtcgttcccgctttgagccatcttcgcccttttccaagcgcctagctcgattcttcgtctgggcggatacacgcctccagcatgatcctctccttttcccttgtcactttatccttctgcgagctgtccatcccggttctgcagacccgcggggcaaggatctcggcaaatcgcttctcagttgcgcgtcgttttctgcgtgcttctaagccagcggctacagccgttgagggctgtctgcgtaagctgaatctacgctgcagagtgtttgcgggtgcttgtgacttgttgactgggttcagttcggccgagatccgagcgagagctgtggtgaggaagacgaaggagatgttgtgtgtcggagagacagtgaggcagtcgaggatctgggtcttgatatcggagattttaggaggtaaagttgctggaaggacgggggcgagcccgatccataggaattttgggaccagcccgtctgtgagagaggagataaacctgaccaatatcgatgagagagcctccagtttatgcgacgatggaatctcgatggggaatgtctgcaaaaggggtttatccgtgtcaagtgcctcagcaagaccaaccagaagaggttccaggacgtcgttggaagcggtccaggtgagtggatccaaaggccagccagggtctttggggatcttcatatcttcaagcatcgccgcatcagcaatgcatcgctcagtgagactttccatagcggcgatgatattgaaaagctccttgggtgctgagaacttctgttcggcatccataggaatagagccctttatgtgccactctgtgacaaaactccgaattccaccgtctggcacgcgaatgagttcgtcaacagacctgccgaagcacgagggtagccagtcacctcgaacggtgatgaaatgatcctttccatcctcaacgcgcatgataaggacctcttcgatggttgctttcccgctattcaaatcgcgaacgacgccgttggatttcacatgaaccgtcaagagggcgaagatggtctctccaggctccagagtcacagacttggcgagaggctcaccgctggtatcagcatgcccggtgtggtctgaccgcgcaaaggcggttgttagccactttgaggaaggctttggcgtactttcggcgttctcatcagcaccatgagggttgtccacaaaagagaaagttgccggcacgcctcccgtattggcgatggtcatatagcgggtcttacattcgagatactggatgtcacccatgtcgacaacattctcacccgaatcttgggtctcggcgacgaccgtaatactcggacgtccctcgttctcagcgcggtctaattctctggctacttcggaatgtatgaaagctttgagctcggggactacggcatcatactggatggagaagctagcgctgactggtttgtgatctgaggaagttatgcgctggtgtgaggtgtaaaattccagagtaatagggtcagtaaggtcgccgccctcgccgtcctcattctcgtcgtactcatcgtattcatcatatccggcagttgagaacttgtctgcaggaacgatatcttctgctggttcaggggcaacgtcttctccatcggcatcggggtcatacgtgaaaaggacatcttcatcgtcctcaatacccctgagcttcatctctgcatcctttttctggacctccttttcctcggctgccttcttgtcgtatgctgctttgtctcggcgcgttcgatacagcacacggtcgcaccagctgggtgccctctgcttctcgctcgtgtcaaataatcctactgtgcccaagtcgtatttataggttggaagaaacgagattggcccctctctccagccgtcgtggaacgcttttttactcctgatcatttttgcgagctggtcatgcggaaggagtgagttcagtgttgcctgcaatgaagtgggatcttggctaggatcctctgcgaaatcgtcagggtcgggaagcgtaggagacggctcgaaactgggattctcgaaactaggattcctcgatggctgtgatgaagctaccgtagtcgcatcatcctcagtgtccgagtcgccaataatgatgatgccatccccttctggcgccgagatatcatccctatcatctgccggggcatactctcctctagcgtggagggttaaaatcctcctgatatcatcccctggtaacccatcgagtcggtagttgagatccccaaaccaaaacacaaaatcttcatcaccgatactatcgccgatatcttccttgaccccagacgtcacgatggggtcgaattgggtcttttgaacaatctgcgcagcatctgcgcaccgtctttccaggttggcaggcgtcacgccactagcgagatgactattcaaaaacaccaagcttgtcgtctccccaataacgagccgggtggagatggcgcccttgttggtgaaccagccccctaatcctgtgccaacctgcttcgtgctcacgttggtgatggtcggtgcgatttcagagctggcgtagatgaggagcaggataccaaacatctgctcagagacaacaagctcataccccttgggcaacgccgcttctatcgccgcctgccacttgatggtcgcagacttgtcggtatacactgcgcgagccatgtactccttggtcatgttcagatcgaccacctcctgtagacccagcacgtacagcccaacctcggctctctgggtacgcgattccctaacagcggtagcctgtgagagatcgagaacattcaggtccttatcaatgccctcgttatccaggaaccaggtggccaggtccttgtcggtccctgggcacgcggccacattccacgtcccaatcttgatcctgacactgcgcggccgaacatattccttgcgacgggcaatcagcgccctcgataacgtatacggggtcgagagctctacgagatcggactggacagaggggtctgccggcggggcagtggcgggcggtggatcgctcatgcttttggagcgcctcgaggaggaggacagggagaagcgagaggaacgggaagagtgagagtgagggcgaggccctttgacgtcggatcggttcttgggtccgggcttctagaccatggtcgtgaggccggctggccgttgtcgacgaggagcgcacacgagcaggcggaaccgtgagcgaggcgctagcaagagatcgaagggacttgcgttgttctggcagtagagctactatacaatggatgacaaaggcgaatagcgacgggaactgcgagctctaatatctaccattcccgtctggagtggcgggtgggtgatcaagcaaggaacgcctctagcgcagcaattgggagggcgtctcagtccgtgacgtagccacttttgccgcaacaaaagtatatcggtaaataaatgtgagagatgcagatgatacggcagatggtcctccaatgctgtcacattggcagagcttaggtaaacctccgctcccgccctgacaaggaagttgaaggctggcccgttgcattgcgattggatttgattacagtgggaggagcccgtgtgttagtgcgtcagtgcgctgcgggagctctccgtcacaggagcctcacaggagcctcggcgcccaacccctgccactgctatcagttctcacaatcagtgcatcaccacccagccctggtgtgcttgcccaatgtccatgctcatgtccaacctcatcttccaacacaccacctccagcccaacaagctctccaacttctctaaaacagcccaggccggctcaccctttctaccagacgctgcgtgactaagagaggctaccctaagctctctttgtgaacccagtcggcgccatcgtgtgcaactgtcgccagccagcaccaaccaccaaacacaaccaaccaggcaaacagaccaccgggcgcctcccacctgcttgcccacctccctctctccttctctctctcttctcctctcctccctcccccccttctacccacaatgagcaaagcaacgcctcgccggtcacggcacaaccgccacccctccaaccgcatccccgccatctccgactacgagtccgacgccgcgcagatgcagcccgagtacgactacgcgccgccgccccccacgcggacaaacaccgagctcaacctcgccgtcctccagcgctacctcccctccatccgcaccatcctcagcatcgccgccagcgccgtcatctacaccttcgccccaaccgagcagcgctgggacaagtccggcgtcgagggcaccatgttcgtctgcgcccaggggcccctgcccgacgacccggcccagaggccccggctgtgcgtcttcgtcctcagccgccgcgggctggagaacctcgtcgtcgacctggcgcgcgtgagccacgtcgaggtcatggacgagctcgtcatcatgcgggtcgaggacgacggctcgactaggaggggcgagcaggtcctcggcgtgtgggtgcacaacgacaagacggagacgcgggacgtcaacgccgccgtgatccaggagagctggaaggcggcgagggtggctgggcggacggaggaccaggggcctgagctgggtcctgccatgcaggcgattgggagcgagggcaggttgaccattgatgacttgttccggagccaagctgaggctcgtgctgcacatggagcttcatgattggattactcggcgaacgggagttggaataatgaattgaggagcagggaaatgatcgggtccctacttctgagcccgatgagctttatggtatgtgctctcttgccctgttgttccgctttccatgatatctaaatactagcaaatcatgaactaacacatggcatatagataccggaatgggttgctactataaaagagcatcacagggatagcacggcacgtaatccagcaatgattgtgctacacgtagatcaaataaaaatctatcaaatgcccatagaaagacaggaccacgagaaagagggaagcaaagagaacaatatagatatatatgtctttgtctacaaggggttgcttaaacaaagcatcaaataagaaacccaggccatacgccgttccaaatcaccatccaatccgactgacgcatgcagtcattaaacattcaattcgctccttttgtgccccatcttgaagtcgtcttataccgttccgctgatggtcaactcccgaatctcctgaagcacctcttccactcttgcgtccagctgcccatctgcgtactgatccctagtgtctgcgtccaggtactgctgcacctgagccatacgcgaatacgcctccgcgcagaaccgcagctggatcttgacgagggcttcgaaactagggtcgaggtagggcacgcgcagatcgatcagctggggcagctccgtgctcagctgctcgttgaggttctcgtacgccagcctggccatctccagctccttctcggttcgagggagcttggtagcgtccttatccggcttctcggccaggcgcttgaccttggcgcgcagggcgtcgtagtcgaggagcttgtgggaccgcttcttgatggcttcgttcacgtccgggaagtaggcgcagaaacgggcgattgggtcgaggacggtgctccggtacggcccatccagggctttgatggtctcggcgtcgaggtcctccaccgcctgcttgtaactccggctcacgccgtccgtggctcccgagtcgccgtagaaggcgtctatcgtttctgcgattcgcatttgtgaggcggtcattgctacagaaaatgaatcatcagtccagatcttctcaatccgtctcggcattggccaaaacctacctctcagcgagtcgagatagcctttggattccttctgtagcctgtttgcggcagcctccatcgtcttgaatcgtctgtatattgtgttagggcgtattctcgattcgtgcgcgcagttgctatccgtacctctcttccacctcatagtcacgatcattcgtcttctccacatgccctgattactcccctccgtcagcacaatgcccccgtatttgaactccgggacctccaagatcactcacccgtcttcatcatcacctgcgtagtcgcacggttcacattcttcttgaatcctatctctgctgttagcatccggcccctcctcattgcggggtgttcatcattgcctacccgcccacgacatcttgatggtatcaacaaaggagctaagaacacggtctcgatcaaaaatgtactgccgtgctaaatgtcgcggtcaagcctcgatgcgctcgtagaatgctgcgcagaagtatgaggactaggaaacttggggcccggagggtggtgacgactgcgtgcaagataataatgctgggcggcttggagaagatggggcgcagccacacttagccgtctttgaatggctgctgccatcgacgtcagtgatggggcgcagctcgtggcttctggcgcagcccgcaagattcatttttccgggagcgaagcgtcgtgtggtgcgtcgctggcgaatcacgtgcctcaatcccagctctctgaaatctcgggctttggctggcggtttgcacgcatacgcatattggcttgtacatttataattttctctcatttcttgtctcgctttagactttgcaatgtttaatcctcggttcctcgtcgtgagtcttggaaatccactaccaaaatatgcaagtttgcattcagcagggcattttgccctcagaggtcttgctcccatcatacaacacccagacttcagggaagtgaggctaggaaaacagaacgccctggtctcgcaaggccccaaatatacgcttgtacaatctccaaccttgatgaacatatctggtccgttcatcgctggggcgtggaatgaaatgctgaagcaacatgatgcgtcttcactgtcactagtcattgtacatgacgaattggaaaaagggttaggcatcgtcaagttaacagcatgggatcgaagccacaagggacacaacggaatcaaaagcatcaaagcgcatttgtctgaagataaatatcccgaatcacctttcgtgcggattgccctaggcattggtcgtcccaagtcaagagaaccgcaggacgtcagtgattacgttctcgggccaatcttacctgagaagcgacaaattctcgaagaagacgtcccattggaggttgcaaagtgtttgaatatcctagagaaggagtggaagcaggagttggggcggtgagggacgacaaacctcgcgcgagcttaatgatttagactcaagcaccacttatggttgcttcgacttttctcaacagtgtatcaataccaacaccgacacatattccttcctgcacgcattcggcacttggagaagcctacgtggtgtgttccaaaagttattcttgagaaagcggtgtatcttcttatcagcccgagatgttggactgacgggatctcaaggctcctctcattgagtatatttggaagattgaatgaggtggtccagtctgggtggaagtttcgtcggttccttatcttcgggttcggtgtgccgagaaaggttgtttgccgccgggatttcgcgaaaacggcttatccatcctcatctaacctaaacagctcaggttctacacgagtaggccgatatggtcaaacaccagcccgcagatatttccggtttcggccgcgagtaatctcgacttggttcggttattggaaatgccttgggaggggctgatacccgcttgctgtaagggacgtggcacgttgggcagtaggtcgaaggcagctgataaccggcgcaggcttggcctagcaagagcaatgatcatgctaactggggtcactcgtgtactcctctctcgctgtcggctgcgggtaccctgcggcgctgcagttcgcaggctcggatcaggtctttgggaagccagagtcgatggagggacacgtccctccttatatgctcagatctgtcccagtctcccgtgctggtcttacgggcgccccgcgaacctaatggcactggcttgcgggaatctcgcatcacgacgcccgcaagaacgtgtttctctacgatcaggcagggctgtgcgggcgttggatggcacaaacgcttacactggagaactcggggggtggacctgtgtctgctgcagggcgtccctatgcttactcggcatgtcgagccgctgggtcatttccctctgtgggctgcggattgtggattctggtttctctcgagaggccgcattatcgaaaccgctaaggctcgatgacatcaaactgttgatggctgtaactatatggcacgattaggtgttgatgagtgagcgctactcaattgaagcctgtctccgttcagaccccaaactggtagtcgttcgccgtggcttagataccataccaataaggtgtcgcatttcacatgcacatcctttctcacacaggactctgggccgactgatatcgagttggaagtttgggttgggtctggatggtggggatgtccaaatcaaaccacacgcccctcccttgcccttcgagtcatcttagcggaagggatttggcactaaaagagggacctagccagcgccaagagataagaaaagattcactggttcagctttcgagcctcttagcggcagagcatttctcatccggaaaacatagtgctggacgtagggaatcttaggctgaactaagggacctgctgatacgatgctgataagttggtttatttgacgtaagaagatgctctctcgagaagagtaatgtttgcatttgcgcatcgccgtcgctaaccacagccgctccgatgctccgcattcatgctgcagaatccgatagtcgtatttgccaaggcattccccgttctttatgtagatggaaaaaagggtcagatgacactctgccatgcgattcttcctttgcctggcgtggggggattcgcgctgggggccatcagctcagaggacgggccgtgctcatataggagttcgtccactgcgcaggagaaaggcgtcagcatattgcccacgcgtcgggtttctttgccggagaagggaggaggatggatattatagctaatttgaaggatctgggaaattcatcggagctcgttgcgcacgctgtctgcgagtgaccatgccccatgtcatactatgctatgctatgctacctcgcccatcacccggcaggcacagcgcgatgcaatcctctcatcctatctatcataccactgaaagatcttcaacgattcgtttgcactagggatgccagcgattggatgggcatttaagcttaaacaaccagtagggatgggagttttccattacgtacaacagcgattctgatcaatgatcattgtcgttgctgtcttggacttaccagccggtcggtttctgagtggttgacgatcacggtccagcaacggcggccttggcagcagcgtgatttgggcgtttctggcggcagttggcggggatcacaggaatccgcagccagaagtcttgaaattgagccactcaaacagcgacaggcagccggtgctcagcagagataagaaagtctggggtttgagatacaggtccattatttgcctgaactggcgatcgatcactgggcagcagcaggggtgagcctgtgacgggcatcagggagggggcgtgctcgcaaggattggcctgtaggaagctccatcgttatcagtgggcctgtctctctttccggctctctccatggctgtcttgcctgtctctctctctttgttcgtctgtctctctcgggcttgtcttgcttctgatttgtctcgtctctgggccagcatccattcattgcacacgcaggatcccgcctaccggaattcctggtccagcccacagtttgcgatcaactgtgttcgcatgcatggcgccgccaccaccgttagctgatttccttgtggctcgatggcggttagctggaaagacaacgtctgccaagcgaggctatagatagacaagatggggtcgttatctctctctttcgacgacaaatcgattctcagctggccggctcgaccagtccaatttccaggaatggatagatgccatcgtccttccctgagcttagatgggatgaaaccccgaactaccatctggagggccccaagatcagagagagacatgaaacaaacggcatgttgcgctacccatggagtagccaaagtgataccttgcatcatccatgccatgtgttgagccagggtatggagagcatggcgtatgctgcatacatgtggtgtcatggactgcccttcactgcattacagcaaatctcacagctcgtctatgtacgactacccaagctgactcgccggttggctttccgcgcaagtcccaagcaaaggcaacctacagcaagctcagccaagggagctcattgaagccaaaaagtcttatctcccccacactcgttagccaccaaccaacatacacgcttcggtccccatcccatccagccgtgcacactgcccctgcctgctcttcgaacttacacgcccctagtgaactaggtccattgatacgggtaggcggagatggagtctcctggctcaatgttccgtcactaggtcagacccccaagccaagctctcggggcttacaccggggtgaggtgactgactgacacacgacacggatgatcgatacttgcctgtcgcagctcagctctttattttatttaataacactcgcctgtcctcccagagcatccttgtttgcttctttcctctcatccccttctctccatcctccttggcccattccctcttccacctcatccgctttgatcccattcaaagcttctggaaaggaatacagcctcctcccaccccattgagggatagacacaagacatcttgcccgtcatgtatgccgaggagtacaatggcaccaccaccgaagccaacttcggttgggacaccgactctgacgacttgaacgtcttctacgatgtgagccagctctctccaattccctatgccgggtgatcagtcaactccttgctaacctcctcctccagactggaaacatgtgcttcctgcttgtgtgcgccgccctcgtcttgctcatgatccccggtgtcggtctcttctacagtggtctcgctcgccgcaagtccgcccttgagctcctcctcctctccatgctcagctgcgccgtcgtgagcttccagtggttcttctggggctactccctcaccttctcccgcactggaaactccttccttggtgatctctccatgattggcctccagaagacaatggcccagcccaatggctccagcgctctccctgacattctcttctgtctctaccagggcatgttcgctgccattacgtgagtaaccacacatcctcagtctctcgaaccaaacacggtctaatatttgttctccagtcctgctctggccatcggagccgtcgctgaccgcggtcgcatcctccccgcgctcgtcttcttcttcatctggaccaccgtcgtctacgaccccatcgcctactggacctggaacgccaacggctggctttacaagctcggctccctcgacttcgctggcggcggccccgtccacatctcctccggctccgccgccctcgcctactccctcatgctcggcaagcgcaccggctacggcaacaacgccggcatgccctggaggccgcacaacgtcaccaacgtcgtcatcggcaccgtcttcctctgggtcggctggttcggcttcaacggcggctccgccctcgccatgaacatccgcgccatcgtcgcctgcttcaacaccaacctggccgcctccatgggcggtctagcctgggtcctcctcgatctccgtctcgagggcaagtggtccaccattggcttctgctccggcgccatctctggcctcgtcgtcatcacccccggcgccggcttcgtcaccccctggggcgccctcatcatgggcgttgtcggcggcatcgtctgcaacttcgccaccaagctcaagttcctcatcggcatcgacgatgctctcgatatcttcgccgtccacggaattggcggcatggtcggtaacatctgcaccggcgtcttcgctgcgtaagtcttctcccaaaccacccatccttcagaaaccaccttactaacagagcaccccagctcctggatcgccggcctcgacggcaccagcccggaccccctcggctggatcgagcaccactgggtccagatgggctaccagctcgccggcacctgcgccgccttcgcctggtccttcggcctcacctgcctcatcctcttcctcatcaacctcgtccccggcctctccctccgcgcctcccccgacgacgaggagctcggcatggacgacgtccagctcggcgagttcgcctacgactacgtcgagatcacccgccacctcaccgacaccgccagcagcaccaacggcgtcgagaccaagtcggaataaagtcttccagagagatgacgtgcttgttatggtgattctgtctaaacgcgtgcatatatatctcaaagttcgcgcacatttttattatataaactacatttaaatgcacatggaaagaaaggggtagtagtcccgtttgacgtaatgcgtgttcttctgaggcgaaggacggagtgatttctttgataccaaattctttttgaacagttactattccttgggtccgtgaagaaacaatggacgatatgatggaatgatacaatcgcttctaatacaaatcaaatacataaaaggcatcatcttaatcacacgtgatggtcacatttcatcccatttgttaaacttgcacgaaatactcatgaaggcaaccagcataaggctaatcataaaggaatagtaatattcattcgttagggaaataccaacttcgtttctcggttcaagaagctattaagatttattgcactcgcgcgccaggcttgtaggaagctggttgcctctaccgacggtcaaccgcctggtcttcagtcccccccccgaggaagtgtgtgcccacaatgacgttggacaggaaagcaacaagaaacgctcatcatatgcctgccatgaaagtaatccatcgctcgtcgccataaggtctcacataacatgaccctgccctcttgcgccgtagtattggaaaatgctcgaaagtgagtagattccattcaagccaatccagcccccgttgacagtaagaaaaagctcatatttagtccacctattcgcccaccccgccgttaccaccgtgtatgcgtataataaaggctatgtgcccatgccttggaaactcaaaaccgcgaatcgtcgtcaacaaccggttgacttgttgcggtaggctcatcaaatcatctaaacttctggttcgtcgtactataacgctttgacatattcatgagaccatgggacagttgcagatgagacaagcactgtcatctaccatgtgttcccagtccgttctacatccgaactgtccagtacactgaattctaatcagcagccatatcctcatcttctgccctattttgagccggaggctggccatgcatgagtgctgtacttgcgcctccggttggcgtgatgttccggctcgaggattctccctctctttggcttcgcacgtttgccacgctggcttgcgtcgatccataggcgctaagaggtggcgatccaaccgcctgctggctattcagaaagcttgaaaatgcttggggcctgggctggtcctcattgacaggatctccactaccagaaccagctacgccagcatggtctagctgggcgtgaggcgggggtggtggtggtagtggtggtggtggtggtggcaacgcgatcaccatgttttcgttgaactcttcggcagtaatcggtggtgcagtatgcacttcaacaaccatctcgttagcatccaagccctcgaagtcgttgtcatcgtctgcaaggtcctcatcaaacgcctcgccttcaggttgtacggcgttgggtgcaacaacaggtcgccgtaaccgggtggttcgaagtcggtctgctacaggctgcaagctgtttcgaagttcctcaaactgaggggccgtgttcagaaaacggcggaagtctgataccatgttaccggagaatacacagaaaacgttacgttgatgttgggtgaattctgcggacgaagtcagctacatatgttcctagaaatggctctttgaagatgggacctaccctgaggagctggtctgcaaaaaggctggaattcatcgcgctgaaatgcagcaacgccagtcaagctcagatgtgttaatctagggcaagagttgagcaaccggatgatgctctggagagaacgaaacagtcagcttgggtcaggaaaagacaaaacgggccagataataataccttgagggttaagtttacacaatagctgaggtgcacacgctccagacttggtgtgtagtactcgccatgaaccagcacgccattgccatctcgacgcagaacaggtcgataggcaaccccggcaagagcattcacagaatcgtccgtgatcgagttgcatttcaccaacccgattctctttagcttagggagcaaagcaaggcgcttcaccgagtcgtcagtgagacgagtacagcaacccaggtcaatataacgaatccggttgcatttgtgcgctaatcgcttgactccctcgtccgtgatcaacccacagtggccaagatgaatgtagtgaaggttcttgcccaatttcgcaatcgcaaacacggcttcgtcggtaatcaggcgacacttcgccaagatgagattgcgaaggcgtggagcagcatcgataatctttgataccgcgtgatctgtaagacgcaggcacgatgtaaggtcaagaattcgcaggtgctcgaatactcggtcctttggcagataaaggaacgcgttatcgtcaatcatttcgcagttggccagccgcaattctctgagacagttgccatgggtcaagagggacgtgaccgggctgttcccgatggccgcacactgttgcaaatcgatctcgagaatgttggggcagttggcagcaaatgcaagtatggcatcatcgcgaagctgggtacactcgttcagtttgagctattgatttacaggttagcaaacaaacgcacacgaagacactactaaaaacatactcttttgatgtacttgcaattctttgcaaggttgatcatgctttcattcgaaatgtttatgcacccagaaacgttgaggccctgaaggcgcttgcaattgtcggcaatggcatttatggactcctcagtgatgtgggtgtcgctcgagatgtcgagggcgagtaaagctgagctgttctggactaaagcaatcaggccggaatcggtcaaattccggcaggctgtgagagtcaagcgctcaacacgggtacaaacagccaaaggaagaacgctgccatcgttgactttgtctgcgagagcagcaaggttgagacgcttaacgaaatcggcgtagttgaagaagggtttttcgaagctgagggtttggcaaatgctattgtgatttttccaatttgtgcatgcagggcggtgccataaaatatcgacggcgtttctagcccatcgcttacagacacgcatacacgagaacaaatcgttgggtgaggtcagcttggcaaaaatgctgatgagaatctcgttcggcagttggtttacgggcggccaacacgaatcatcaacagccatgtcctggaaattgtgaacgccgatggatgactctgagtcgttgttattgaggaagaagtcggattcctcgttatcggcagggaccggggagttggttgtggaggaggtcgagcgagaatcctcctgttcttccgaggcagacgtcggccgcgacgcctggccagcctcaaccgacgagaggttggctgcggagggctgcatggcaacggcggtaggggttggtcaggatggcagtcaaaatcaggtatgtgtcggatactcgtgctgcagagatgcaggaatgtgcgatgcgttgccgcggttgttggtttccagcttcgtatggctagatgcgagaggttttgatgatgtttgggctgctaccggtggggtttttcctcatgccaaaggcagactctgcttgctcagcgtcatcggaccgcgacctgaccaccggaagaggcgaaagagaagggacgtgaggatcgtcgagtgcccgtgacgatctcgaagagggatcgagcgccagtgagaggttggataggatacggggtcgggcgggatggctggcaatcgagcttcgatgtgttggggcgtgacgatggtggatggatgggatgggaggtccaggatcacagggctgcgacggtgggtaaaaggcgggaggaacgtagcatgtaccgcctacaaaaagggcctgccaattaggcgtggctgagcagaaactcaggtcacttcaacctgtgacttagtcaccactggcgcccggcattctctggctagctgctttgtaaccgcggtggattagcagtccagcaccgctaggtcaccgtctttagcgtgttgttgtgtcctggcgcccgaatcagcagggggttaaaccgtgctggctgcccgtcctgccagtcttgggcagccacaccactcagtgataccgtattcaaggttgattctaggccctggcacaaaggaacttatgggccatcggctcgtcgagcctcgtgtaatgttcaacttggaatgttctagccacagttcttatgagaagagctgccatgcgtccagccaatgcaaaggagactacaaattaccatgcgacaaccgccgatgaggcacaagtgaaactgtcggaagtctgtgacctagcgcgtggctttgtgactcgatcagatgcccgcattaacaagcccatacacggcttaataatagcacattcggaacacatgagtggtattgatgcacaacaaggaacatcactcctgacatcaactttgtgacattagtagacgccggggtagttattgaagtttaattctgttttgtttgtcatgattcatttgagagaggtgataaatctaccaagatgagcaacataaacctatcaatataatcctcgccaacccgattttgagatacataacacgacagatcaacaggttactttcacatgacatgaataaaatgaataacaccaaatattcctaaaactcgcctcagggttcaatggagggaccccatcccattattatgccaacatctgcatcgctgataagctcttcgacaaacgtagctctgttatgtacagggtaggtgtatctgcaccgcgaagcgctgaatctccatcatacgtcacgtgtggagcccttcccctcggatacagacggatgtgctgtgtggatgcgctctctaagactgctaacgctagaaatgtcaattgacctcaagcattgattgctggctttcgtttacgaactacgataggtcgagccccttggtgaatttcgtaagtgacctgcgatactcgataggagcttcacactgcgctttctctccgtcggctgcgaagttcgagacgacagtgatgattcgaccagccgcagcccgtcgggtcattccgcggacacgatgcacacaaaccctccgttcctccccagctgctgcgcgacggacctttctctcatcgaagagttctgttcgcgcgacgcaggactttgatttgaacaagctcaacactaagcgacgagactacgagcacaatcgcaccgccttcctcatcgccggcaccgtcgccggcatcacctcattcgtatacactgctttcaagctaaaggatgccttgaaggcggaggctgaaaggaggaagaacgaaagctccgcacagtgcgatgcccctatgatacccaaggagcagttcaagacggaggcgggcgagaagcgcaaagttgtcgttcacgacgaggacggccaggaaatcgtgcccacaggcaatggcgttgtaccggcctttcctcgactcctcagtgtgaaactgccatccgagcagacaccgcaaggccccattgcggcgtcgatttcggacaacgacggaaccgagttcaccctggttgggctcgggacccgtacggttaccttcatcggcatccaggtctacgttctgggcttctacgtggccacgcaagatgtggccaaactgcagagctacctggtgaaaagtgtcaactctctggctacgaccttgatcccttccgagaaggagactctgcgcaagtcgctgcttgacccggccgaaggcgaggagacgtgggacaagattctgcgggacgctggatgccgcaccatcttccgcatcacccctgtcaaggataccgacttccaccatctccgtgacgccatggtaagagctatcacgggccgatctcagcgtgatgcggagcactatggcgacgagcaattcggcgccgccctgaaagactttaagggcttgttcaaccgcggctcagttccaaagacaaaggaactccttctgagccgtgatggagccggccagttctcgctcatgtttgacacatctggtagaaaatctcagaagaccaagaaggaggttctgggcgtgatttctgatgaacggatatctaggctcctctggctcaactaccttgctggaaagaagcctgcatctgaggaggccagaacaaacatcattgatggaattatggagtttgtagagaggcccatcggcactgttgccgcccaggtattgtaatacctgtgggatcacctaccccggataatgtaaaattgtacaacacttggaaagctgaatccacaccacttcagttacaaaaagaaaaccgatggcctgagttaggcagtgtcattttatgtagtctacacgatctgaaaacacacgagtcactggaggcttgctatagaattaaacattcttgtcatttatcaaggttgagagttctaattttcttttctttcaaaactcaactggctatgactttatttatacccgactcccgcaacattcctcatctcagccacgaacgaaaacgcttgctgcatttagagcttgagcgagccggcattgcggaggagttgctccagttcgccggccttgtccagcttctggaggtcagagttgcctccaatgtgcttcttgttgatgaagatgttggggacagtgcgctggccgctgatgtcctcgagggcatcctgcagggcagagccatcagctgcaagggaaggtattagcaaaccatttcagccgccaagccttgccatacgaatgcatagcaggaacgggaactcacagtcctggtcgagctcaatcacgaaagcatcggcattgagctgcttgagcgtcctcttggtgtttgagcagtaagggcagtacgacttcgagaagacgactggaatcgcggggaaaacgcgcaggtggttagcgggaggggttgaaactcagcagccaccgggagcgggaaaattcgactcactagtcgcgtgctcgttgatgagctcctgaactcgggtggatgcttcgcccattgtgatattgcttcctgaaccaaataatttgtttccgagggcgcgaagagacatgaggggcagaggaggatgggagttgtgggcggggagggttataaagtaaagcggcaatccgggtattagctgagatatgatgtgcgaggattagcaatcaatcagtccgctctagaggcttcggctgggctgcttttgggtaggatatccatcatagacgcggccggcgggtgtcttaaataaccttgtagcacacgccgaggcctgtagaaatggctatgtcatagcccgccatcgccgtcacttcagaacttcagatctggattaaggatatttttaggggtgttttcagggtgccatgcagtgtcataggctcatcggccggggctggtatgcagcttagggaagagtgcccgtcgttttgccgcaaagaggaagtggcagttcgaattggcaaccccccagtggctgtgagatcgatgaaatctgcgatcgcctatcgaggttagacaaaccgataaccgtacgatggacttgatccatgtggtcgtttgcaagttaccgggcggcgcagggtgtgcacataccacgaatataaatacaaggtgattttcctccaggacaaggctttggcgactgtgggggctctcaagcgattccgcagcgcttgtcattagcacagcacctgatctctagatgacgtctggtactataaggtagctaccgcccacccgaatgctgacgtcggcagtgtcccggggcgtaaactacttactccgaagagcgctatctttagcgactttgcattgtgtgaaattgggtcaatgtaagcgaggacactggattcagtcaggccggagcaccgaatatcgcaatgaccatcagaggagccatgctcgttatgcgatgcgacatgttagacgttgcgatagatgagtcgtggaggagtggttgcttatggagggctatgcactcacgaaagcagctggtgaaaaggatgggattacaagattggtcgtttgaactcaggcttaggcattcacccaggctgtcagtcagtagacaacccaatggtctgacagagtgttgccaccattactttcaacatcagaatcgaaacaccgccaatatcgttattactcatcttacggagcatggcactgcagaggaaggaaacattgcggggtgtgtgcatgctgagtgcttggagcatcgaagcctcaacacgtatctcgcctgtttgggaggccttggggctaacgacagaccggttgccgatctggatgacatatcgacaccgctaatctgaagatcggcacgaatgcagcaggaacaagggccattatgcaccagaaaccaacctgggtgttttgtcggctgaaacacaatgatattgggcctttattaacggtgatgctgaggatgaaacctggtgatcgtgttacccctctaaaggttacttgtttgcctcgcttcgttgccgaatatcatagtgagggttgttggttatcatcacaactgattgatcgtcatgatgcaggggcgaatcccacacagactagatgcgctggccttgcgtgttgtttgctaagttcgtggtctggctttagggtagtttgagccggcggcgatatttcaagggtccttccaggatatccctggctgcggtggtggacttgtaaccacgagacctaacgaggcgaacagcgtcatgagcgtctaggacattccgccccagattgacatcacgcggaggactatcacagttcttttccattccttcgacctcggctgctggacagaatccgttcggagccttctatagtataacagctgtgttgggctggctgccttctccaatggggtcacgctcccgctgccagctgacagtaagcgcccctccgcagacatcagtcaattacaactatttagatcaatttcgtcgatagatactagaatagtcaaggggaggctcgtatagacgcgttcattgtccaaggcagatctaagagcccccatccgttcatcggactttccagctctggcaggcggcggccatgtatcaccaacaagagatccattgtgcttctagggccatgcaggtgatgacttagcgccggctagcgttgtactgtacgaagtaccccaagtacctatagcagcctggggtattggcgactttgaaagcaacacatcgggtggtgattctgacttggccacgtttacattgccattctcatacgacttgaattgggcattcgtacggcagtttgcttgattggcactgcaccatgatgaatgattcgtgacaggcgggatactaggctgattgggttggcaggtggcacttggtgcaatattaccaagcttaagggaccccttttagggccaatcaagcgagggcggcaggtaccttttcgcctgggagcatttcccaaattcgcccatttcccccctatgaactgcctgccagcgcgtcctccccccttctgaaaaaaaaaaaagaggtggtcaactggctcccaaaatccactatcctacatcattcttgctctccaagtcaccccccttctgcccaaaaaaaaagctacattgttggttttgcatgagaaaccacacataccccgaatgcagtacggcacgagctagtctgacctgcgaacatctagccaacgagacgacgtcaatccgcccatcgccccccgccctgcctcatctcatccactggacacatctcgccgtcgacgcgccccccacattgccagctcattcattcgcgcagcgtcttcctctggtcctcccacggcttcccgtggccagaagattccaccaccagggagctgccctggagtttctgttgtgatcgtctctgtgcgtatctcggctggaccgaccggacaccgcctaggtacagccttcgcttggtgcaaccaacccatatcgtcggtgctgcagacgactattgcagtccaccgaaccttggtccaacaccctgtttgtagttgctgcacaaaaaaggtgtcctaccctgggtcaccttcacccaaaccgacaaggtggattcccgactgcccatagcggccacctcaggtgcctttcaaaacttgacgtcctacctcaacgagactcttctcaacttcaccacagcattccacggctctggcgagtacatctccgagtctttaggtgtccctcctagcgtcatctacggcagtgtcgctgccctcgtcgcactacccctcactatgtccagatactggcctagccgcgggttctcaccatacgacaccctccccgctgatgcacccgatgtgacggacgaggacttcagctacatcacctcacaagaacttgacgaccctagcctgagcgttcctgttgacgcttggcaccacccccgcacgtaccgccgcgaacgcgaaccggaggacgacgttctcctgatcaagaatcggagtgtcacatatcccgcccacttccccgcatactcaattggagacggcaagttgcttgtcatggatgtgaaggagcgagttgccctcctgatggacctgccagaccgagtcgctcgcaaggtcaagctcctctacaagggcaagcatctcaaggacccttctgctcccgtgcgagagtatggcgttaagaacaagagcgaattgatggccgtggtgcccgagggtgaggatggtagcagcccatcagagggggagattgtaaatgttgtcgactcaagaaactcgagcaaaccacgccgcaagaagaagggcagcaagaagaagaaggatagatccagcggaggtgagggcgacacaaccaccagcccacgcgatagcaattcgaacttcgatcctccaaactccccacctgcaccttcagcccccattggagcgggccaacctgttgtatcaccactgcctcctcgttctggagcaacaactggtccgctgaaacagctcgacgacctgacagaggagtttgaatcaaaatggttgccgctgtgcaatgaatatattcaatcgcctccttctgatcccaagaagaggcaggaggagcatctcaagatctcggaatccgtgctgctacacatcatcttgaaaaccgacggagtagaccccgacggagctcctgatgtcagaccccgcagaaagggactggtttcatttgcccaggacgtattaaagatcatggataaggtcaaggaagctggccctaagcaataacgatttaatcacaacgggcgacgcaagctcgcctaccacatctcggcgttctctatggctctatttgtcatttttctaatttatatacacaagaagcttgtgcgttctaaagagcgatgcaatggttttcttcaatatacgttcttacttcttcttttacaaaagaatggagttattaggtcccctctgagcgggccgctacaatcccctcccagcaatcctgagagtggttctgtatatttacttgagcgccggctttacttgccaggcctgcgatcgtcacgactgtcacgacatttaaatggaaagtgggccttgaagattggatagactgcggacaaagatgagacagatagagaaatcaagaacttgggcgcttttgtttttcgtttgtagcatttcaattcctggtgtgggtcagttcaccagccagtttgccagtattagcatggatttctaccaatttacactcaactccaccggcgatctgcatatttagtgaatgcaaggcccgaaacctacatgagtagtcggtaggtacccgtttagggagcattgagaacaaagccaaactatcgcggcctgtagttcttctaagctttctggcgttcgctggccaaaaggctaaaagcgatgaatgggtgtcgatcgggacagcagatctatgccgctttctgcgccaagcgttgatgtcattccttttggatgccattttctctgcctcacttctaaaagtgctatacgaactggacgttaatccaccccggacgattgggcttgaattggggttggattgatcaacaattaatcctcgtgtcgtgtccttgcctcacttttttgacccgtctttgacacgacgatcaaggggcactgtgttcgtgtctgctttggtgggatgggtgggtatgaggataatgggaacaagatctacagccacgtatagaagttcgccgtcgcaatatgcccaacttgagttgggtcggaccgtggggtttgctttgcaaggccggaagacctgcaggacactccacgcgcaatgcgaatgactagagggacagcaagaggtgtgcaaatgccctaccatgggctcccgcggggcaagcatccacattcactggatctatgttgacgatgctgctcccgagaatcttagacttccaatcttagcagaacaaggaaaccgggaaatttttctggtgccacaatatgtaaaagctgccggtgctacaatttgggaacgaggacggtagtcaagtagtagtacgcatgggacggtaaagttacacccgaagctgttgagtaaatgggccgtacctcatgatgcaatagcgatacctcttctgaattggacattccagaggcaaccgtgagtttctcgccagccgtgagatctaaacaggtcgcgtggcgcaacaggctacttgaaagctgttacagcagttggcatccatggaacaaaccatctcaggcacatctgcgctttggaagtgtgcggcttccataattgacccaatgacacaggtcacagggctacgcactaacatcattggctgatgacaataattcccattgtccgagcctgggcatcagagcagctcggtgtacaatcgctctgatatcattcctggatttagtacgtaccgccacgcattatttgcccttcacgtgcagcgttgtgtctggttccgggccacggctgatctccggacgttgtgctaggtctcagagccctaaacgcaccaagtgcgcagccctctctcgctttcgagtaaaagaagccctttccagattaggctaagcgccctcttacccaaggcacaaccagcccttcaagcggaacttggattttttgcccgtcccatatatcgcgactacttcaccaaaccaaccgggacgactaacccctccagcacagcaggacagcagcagattctcgccgggccgttcgagagtttgccagatattcagctgtgacttataccatttcattctctcatttcgcagcaagtgagaaagggcagcacaatgtcgtcgcagttcgagcaggtcgtgagtactcacccacaagtcctttcaaaacagtcatcgaattgtgcgagagggtgtcgagatgcaacggagccaatcacttgaacagcctcttggttcaatgtaccgacatggaatgaactgagcgacgggctttgtgtgacggacgacgacggcgcatctcgacatcttcactttctcgaattccaaatatggcttgtgactcgaagaacatctggctaattcgcttctctcacaggtcgttatcgacggcaagggtcacctcctcggccgtctggccagtatcgtggccaagcagctccttagcggtcaaaagatcgttatcgtgcgcgctgaggctctcaacatctctggagagttcttccgtgctaagcgtacgtcccgacctcccaacacttgcggatcgattccaatcatggagacaacgtctctctcgacgacatcactaccgtacttttgctagggttggctaacgaatatacagtcaagtacgccgcccacctcaggaagatcacccgttacaaccccacacgtggtggtaagttcatggcaggaacccaaccctgaaaacccgcgagacgctgacattcgacgcccaggtcccttccacttccgtgccccttcacgaatcttctacaaggccgtccgtggcatgatcccccacaagactgcccgtggtgccgccgctctcgagcgccttaaggtcttcgagggtgtccctcccccttacgacaagaagaagaagatggtcgttccccaggctctccgtgttctccgcctccagcccggccgcaagtactgcactgttggccgtctcagccacgagaacggctggaagtaccaggacgttgttgcccggtatgtttatgcaacccaggattatgaattgacgctgtgggcgagaatttttttactgactatttcgatagcctggaggaccgaagaaaggctaaggctcttgcctactacgagcgcaagaagaccgctacccgacaactggccgaggcaaagaagactgccggcaccaagactgagacgacccaggccctcgctgcctacggctactaaattagccatctctgaccaatccccggagctcgacatggaattcctggtgacctggtcattgtccaacatttctcatgcgtttcattagatcggcgcggcggttttcacaaagggatttacttgattttgctgcagggtgatgggcaaagggcggctgcgcggctgcgactttggaccgggtggattatgggttggatggttgatcaaaacagatgcattgatgtcagtgaagacctcacaacatggttggaaggccatcccgaaataaagcacagaaacccaaaaaacaaatcaagatgatgacgcatgaggataatggaaaaagagaggttgctaatgatgtgctgacgacggggatgggccatctcctttgcgagtgccaatggcgaagtgattctgactgccggggagcccttgttgggattctccgatggacggagttgctttggttgggactcatcccacatgaattgctcttttttgcatttttggatattttaggagtagagaacaggaaaaatgaatcgtaagtaattgcttcttccacctagaagtcctctgaaatgtgccccctacaccatgacctcttgatcccatgcttccatcgtagttctcaatcgtttctgctctttctgcataagttatgtctacttgtgaagcgagatcattgggtgttcgtgaatagtactattggtgggctaagagcacattccagcgtactagaaaggcccggactctatatccacaaggaatcatatcatgtaccttatacaataagaattaagcctacattgaaaacatcgtgatcactttgagttcggcactgaagaaatacagccctacatcaagggttataccgtcatacagatgtgtgcggtgtcgcccccccagtcatgtgccgataagataaggaacgccaactttctgctgaggtgtcctattcttgaacttttgggtctgggggttacaagtggctcgaatgccccggccccggcaattgtagtctcattcaacgacctccgtgcacactctttttttcacaatttctacggattgtcatctcctagacaaaagaaccacacagtctttacgcattggcagttgcgaacaagagagggaaaccaaagccaggaacagcaagtgcgcaacagcaagaaccggttgatatctgttcaacctcacctctcccaacctagctacacccgccaccaaccacataaaaaccacaaccaacacaaccaacaccatgtccgacctaacgcacttcgacatgcagcccatcctgatggaccccaagtccaaggccataaccgccgaccccaacatcaaggcctcccgcgccctcaccgccgagctcgagctcctcaacaccctccaccgcgccctcgtcacctccgactccgttcccccctctggcgtgccccctcccccagtccccgtcaaccccaaacgcggcgccaacatcacaaagctccgcgacaacggcaacgcagagtaccgcaagggccgctacgccgaggcccagaagctctacaccctgggcatccagatggccctcggccgcccgctctgggagcccagcgcgctcgtgcgcgaggagctgagcgggctctactcgaaccgcgcgcagacgcacatggcgctgcagaactggcccgagggcgccgtcgacgccgagacgagcgtcgaggtcaagaagattggcaacgccaaggcctggtggaggaggggcaagtgcctgctcgagatgggccggctggacgaggccgcgtcgtgggtgcggggtggtctggaggtcgagggcgaggagggggagctggttgcgctgttgaaggagattgaggctaagcgggaggctcattaagcgaggagcgagagtgtggaaggacatgtggtatgagggacgtcattttttcttattggcatttttatggttttttttttattttttattttttatctgggattaatttgtaggaatgggttgctctaatgctgagttggtcatatatggctgtattagctattgagatgtatagaaggagctgaggctgcccttaaaggtagagcttagatctgctcgcgaggtccaaaaaggttaagggtttcttttctagctgggcagaagttggaatccagctacctagcacatactctggcgttagttgaaatatattcatgaaccagtgggtgggcaagcgattgattggagtttcttcctaagattgaattctacatcattttctgtaatgggtatcagatgcaaattcctccaagcttgatataaaacagaaaggacgatcatctcattgcgttgagtgtttttgtagctcatttcctccggggtccgtcgtggcccatttctcatgcatagactttcattccattccgtttctcaaactctctttcccctcccaaaatcatgctagcaacagcgttcaccgaaaacagacaaaacccaatgtgccgccctgaaagaaatcctggtatactttatcctcccgccttcggcaacaaatatcaatcctccgccaattggtctaagaaaacaagaacgccatggccagtggtcatgatcagaatgattaaaatgcaaaaatcggtcattcatccaaatgggatgaaagtggacgaattgttgagcccgatgagtattggccctgggggctggaattgtcgggtttcgtggtatatatcgtttagcccttgcatcacagcttccgtgcccaagagatcatcaaggaatcaggtcgtcggttgtcagtgttcgaaagaccgtctggggtctttttcctctggatgacgttgaaaatacgcttcaacttggaagagtttacagcttcttcttctgcagctttgtcaacaaggcaaccattctattgtgccttctcatccagagtcttgttgacgctgctcttgcctcgtgggcgcatgacggcatcctggctgctcattcggcggtcgagagcgcggtccagcttggcaccgagggcgagcttctgcatagaatccgtcttctcctcgctcagaatgacgcgctgggaggagagagccttgttctccatgcgatcgaggccggtcgcaatatcgcggatttcgttggtagcggagtcgttggtttcgacggtggcggccagggacggggcagcggcactgtaggtgctgaaccgcagcgaggcacgggtctttgtgcgggaggtttgcgtgttagctggcattgttgcggcaacgcggttttgtgctgaaggtgtgttgagtcgagtgtggcagagagtagatcgggaggatgctcgtctacttctgatgctgaagaggatcaaggggtttggggaaggcgggcagggcaactgaagagccaaagccaggccaaacaggcgttatgcttgccggaatatctgtgctgggggaggggttcgtggaaattgaattggccttgtctcaggcggtgatggaaattggaatgtaatgcaagttgatgcgagggaggcagcgtcaagacagacttggtcaaagacagagcacagatcccaaattgcagagagacggaggaggactgattgacaagagggttgaaacaagaggcggcggcaaggggaggaaaaatacatactgatggagccatgatggggcgggaggagtccagggatccaggcatggttgactatggatgacacaggctagagcgatcttaccaactgcgtaatggtcgggtctttggacggagaatggaacggcgtatgacggcgcaaggaagtggtcgatgagtgagggtatcccgatacgatgagcggttttgaagatggatgtaggtcaagagtgcgagggcgcagagggtgtgtgcgtggtggtgtgaagttattgggcgaggaaggtccagggcagagaggaatcgggcttcaagttgagctcaggcgcgcccggaggggatttgactctggagatggtggccgggggtttggcgtccttgtgatgggagtggacctagggtggtctgacgacggcgtggataaccttgtgatgtatttccgcttggtctggtccttaccccgttgagggtcggagagggcgatgggcgttgttggctggagagctgtgggaagccaggaacagcggacggccgtaagggacaagagatggacggcactaagaggattaatctgggaccgcagacgtcaagcaggcgaccaacggcaaacaagcaacaaggtgcagcaggatagcgggtttggttgggaccaacgatgcttctaattaaagcgaggagagaagaagagcaaacagcgcaagttaagttctaggattgggagagctactctggataggcgtgggcggaccaggctaaccaaggggaccaaggggttccaacgggtctgggaggctgctgtggttggctcgtgcgggcagccagtggaggtctgcgacaggggacaggggccacaggaacgagctgcacccggtgcaggctccagcgcgagcccgtctgtaactaccagctgcgcgcaggtgctgggatcggcagtgctggggcaggcaggcggctgtcaattccctaattcttacctgccgcccgctcgtccgtccatcggtcgctgcaatggacggcagggtaggcaaggtagcccttgaggtcgcgctcgggggatctgtctatgaagcgagcacgctggcggtgcgcacacacacattcgcgcacgccacagcccaaaggttagggacggcagcgatgtgcctcaggcggctcctcattcgacaagtttcacgtggtcggtgggggctagactcaggggagcccttgccatgtgcgagctgcagcttgcgtgtgtgcgtgcctgttcacaagccagacatacatgtacagcaggtagccactgcccgtcatgccctgtgaggcagtacgtacatgctgcgtaggcgtccacctcaggcaggcgcaaggaactgcgacatccggtccgtagacagtgcgagcagcccccaccggccgttgcggaaacactgcagccctgacagatctaaggtaccgaggcctcggccgcagcttaagtgaatattactcgatgatgtatggctcggtggaaagatttggaaaaaattcgcactcagcttccaatcagtctgttgccccgaatacctacccagatatggcggctccagagggtcctctcctgtaatccttcggagatttctgcccatgcaggctctaccgagcacgtacccaggcacagcgggagacacgcattattgatccctcaggcccaggctcagggctgtatcgacggccggtagagatcccgcacccctcgcactgtgtggctttgcaggttttccttctggctctgacacacgaaacactcccaaaccacctcctcatgcaagaggctcaatcaatccgccctgcctgcacatctcgctcgatttttgctctccgtagcaacctgtccggtctctcggctgtctacttccccgcttcagtctgaaagacacaactcggcggattcgctttcgttctccctatatctaggtaccaaccagcatgcaccttcctgttggccgttcgtgttggtccttggcgaaaatagaaacgtgcgcgagccacagcttcggccttcagctcggtgtcttaccatctgcggttggtgcataggcgcaccaggctattgcatattatagagcttgctatctatggtatgtcgcacacacacaactaggccaaaacgcatgggattgcggttattgcctttcaaaaccaatttccccactagggatttttgctttgccacgctcggtccccaatattcttaatcgctacctaacatcccttgtgtcggtgacgttgaccaacgtcgatccgagcggcaccagcatggcctctcgtcatatcgtcacaacgttacaaggtccagataacatgtcatcaccacttggaaagatcgtcaggtagtagtttcaaacttcggtggccgtgatctagaccaattctgaagacaccatttgcagggctctcggtcagctcacgtggcccacccgatcctggaagacccttaccgatgagcgtcgagcatggatgcgatcctgagatcctgggtgtggtgtggtgtcagcctgcatctacgaatgtacgactccatcttgttcccttagtgagatgtgtctgccacatggtatgccaacgccaatagtccacatatgagctgtgccccgtccgcacatgcttgagttgcatagtaagcctcaatggtccgaacagacaagtgaagctttggtgccccgtacgcttagggttgatttgaattgaacttgtgttgtgtcgcaatacccctggcttctgttgtgtgatcggctggagcgtggattaaaaccgttgtcacccatgttgagcgctcaataagcggcatatacctcacaggttcaaaccaagacctacattgcatctgttttgcaaacaacactggttttgtcctagacatcagtcatggcctacaccgtttgatgcgcactctagccaatgccgtgccctggtgctcctcttgccaaccttttccccgatcgagaaatatagagttgctgaacctaggctgcatgagaagaacatgctcaactggggggtcggacactcgaatgtggtgtggacatgagttggaacccctcgccgccattctgagttgaactctcactctgcgccgaggatctattcagcccatgcaacattgtccttctccgacctggctgatttacgaatacggacgttgaaatacacctgctagccaaaatgcgggaagctcttcggttatcccaatccatgtggaagggaatgacgattgcggggcctgggcagatccttgttacggcttgtgctacgcaaggggatgggaggagatgtgctcggtagtgctgagtgcctgatttctgccctctggctttggcgaactacatttcgcagctgtatttgagcaggctctcagatgcctggcaatacccgggcactgctctccttggacagagacaagtcctcagctaatgcagacttccggtgacgctgcggctagacccatgcgccacttgccatacctacaaatgagctttagaccgtcttttacaatctcgtgtgttgtgaacaaagacgttgccatggccgggggtttgagatagagggcaagccgttcgagctctgtacaagtcgactattcgtgtggacctcttcttgaccttgccaatgctgtgataggaaagaaaatgcccaatgagagtaattgttcgacttctcatttctgggaaggattgagcggcacttgacatgcctctgttagtcgacaagccaatttgccaattccgatatcgcagggtgcgaagcaagggaagctctctgattggcaatctcgaaggtcattaaaccaactacaagtttggccgctcttattaatttacttttgcggatggagcaccgttgatatcttgtcatggtaggggtcttgatctcacgttacacaagcggcactggccactaccgaacgctcagttggctcttcaccaagtctacgcctacgactctcagaggttgttcaatgcaacttcgatatggagcgttgtaacgcataggagaagacgggggaagccagttcttgtcggctcgtcgctgtactagctcggccgattcaatcgtggggtgagttgttcgcccgagacaaccattgacagcagggtggacccgaattaaacagatcaagttccgagacttgaccgcatgtggctcgtccgtggatggtctgagttgaaggtagactcattgcccttttggacttggaactgaagtttcgtcggaccaacccctcgggttaaccactgacttttattatttcttgaaacactcgatgagactatcgctatggatctgtccctcaacgtggccgctttcctactccctctctcactagactgtgcgacctattactccaacgaccttccctttctccccttgcgtagttacttgttcagccgcagtgccctggtgtgcatgtgtcacagcagatatggtcgcagcgaaactcaaacccgccctcgcgcatcacgcagctacatcgacccaggtcattgtaggcaaatccgcaccagcagcagttccagcagcggttcaaagtttcgtacggacaatcgggcagcgcgcatggcgggaggatccagttctctggcggaggatacgggatccatatctgctcgcatcggcagcaagcgaccgttccatccccgggagcgtcctcgcagtatcgtgtgctcgtgtagaggtgctcgcagggtagttggcaggtaagtcgacggcacatatttttctctctttttctttttttaatgaaaggtggattggagtatcttttcttcagagatcagagacacttcggaatctccgagcgctccgaagcggttccgtagggatatccttggctgaggtcgagatgacggcttcgttgtggctgagtcacaggctatggaagcttcgtggtgatggtttgacgaggcacactgatggcgccgaatttcaatagagtaatttcgtcggtgattcaaccgcctcatggccatgggaaaccgtgaatagagagaccaagaacaggactgccttttgcaggccgggctagacattggcggccgcttgtcgaagccgtatttgtcgcgccagagcatgctcaaggagacgagaccaatcagtctgctgcgcgggaggctacgtagcctctcatataagcaccaagactcaaggtagcatcgtctatttaacctgtcactgtcgtacctctatacacgctagtatcggtcggacaggccgagacgctgacattcgagcagcccaggccattttgatgccctgtactctgatgtatcgattatctgggtgccagtgcagactggtctgacatcattgcgttgcgttggctagactctttgacatgttgcccttagaagccaggcagcagcctgatatcttatacaatgagtggaaacgccttggccaatggcaaaggcgtggtcaaatcaggaacatcacgggagaaatcagatccgactgatgtcagatcataggaatgatatgtctaatctggactatcaggcatgacgttgccctctgtagctagtttcccacacgagtatcgtccttacatccagcctcccataaaaaaacaacttcgtataaatctcagtatccgctcgttacaatcgccattttacccacccagaacgaaaaatccaagccagctgtctcccctctccaaaccctccctcaccccttccccaatctcacccagaatcaatggcgaacagaagaaaccttcaagacatgaaagccctagtacacccctgacacacgcgatggtagcaaaacgtgtccgggctgcccctcttgggctgcaggcagtacacgtgcgtgttcccgctccgccggcagcggcagcacacccaggcgccgtcgaggtcctcgaggcggcagaagcccgaggagcactccggggagacgatgaggcagccgggcggccagggcgcggtgccgaggggggaggaggaggaaggaatgtggatgacgttggggcaggtggccacgatgcgcagggtggccgggtcgcggacggcgtaggggcagtaggtgtagcttattgagtaggagggggcgcgggtgcagggggctatgtggtggtagaggacgggctggccggtgcacattttcggagggaatggattggttggttcgaagtctttgcggttgggctgaagttgagagatgggttggctgttgggaaagtggttgtgttagtgtgttgctgtgagatgggagctaaggtgttataggtacctggtgaggagagatgggatgggcgtagcaagtgtggccttgatgattcaatcttcgactgtgtgaggagtctgttgctgattgttgagtttgggctgactgagagaagcctcgatatcaggagaagagcgggagtactggtcaagtacgaagtagttaaggtcaagtggcgattgagattaaatttatactggcttggcttcttactctactctatctctcgtcgactagttttcatatgccgaacgcttatcattgattaggtgacttgtctggcaaacaaagacgtaggtaaccgttatgcgttggcatctgtttcggtattgagcccgttcgggtgtgtgcagattggcttggcgttggagcgggagccagggaatttcactctgcatcaaagtaacggctgctggagaatttttgactggaaggtcttttgagtttcgatgtcatgctttgagttgaattaacacgcagctaggctcatcggcgggtggtcggaaggctgcaggtacttataacatgcccgcttcccaaggctaattagatctcaaggatacattgtttgcaattcggagattgattatcatctcgggcccgtgaatttcaagcttggatggaaggaaccataaggaggcttctggaaccaacgtggctgggccacactaaccaccgaggaggatagtaaagtaaccacgggtgtaccatgaagtatacccggaagcaccttggtttccacaagagagataatgaccctcgtgtgatcgtttgacaaccggcggtaacttggaagagcgcacccgtgagcaacatatattgccaacatattgttggattgagtctagctcgatggtccggcatagcgggcggccgcgctgagatgcaatctggtggctgtatttgtatcacggccttgcgctgagaaccgtgcgcaatgggtcgctgcagattcaactaaccgggctctcctcaatacgcgtggcgcaaatggcatcaataccacgcggaagctgagccgggcccggcttgctcaaaatcctcaagcctgttcgagaacatgagggcgggaaaacggcgcaagcattgtgtccagatttgaccctatttaagaagctcgtggaacagagtgaagactcgatcgagaggtagtaatgcccatccgatgcggtactgtagaggggtcgtctttgaaagcaggaggggttccttgtgggacaagggacaaggccacttttatgcgtggttgagacgaacgttgtgataccctggagggcaatccgttccagaaacctgcaggaagcgctaagccggcatcccgtgacgcgctggtgctgttgtccttgctttctcgttgtccaggtggaacagagttgcccgtgacccatactggaggaatgggatatctctgtaaagaagcgtaaaagtaacgtgtgtctcggtagaggcaactgccgggggaagctcctctgtgagcaggatccaaacatggcccgttgagaggtctcgtggtctcgtgggggtggtacaggaacgtgggtgtatatctacccaaccgtttgacctcgttggcggttacaagggggaaaattggccgagacagttatgacgatacactcaggcgagagagtatgggccccgtattggcttgattattggtatgtcgccattgcgtggttgggaacagcggccgcctacggcctacaccgagttcaagagtcaggggtggtgtagaaatagataagctttcagacggcgagcgcgaccagttccatcgtacagccgaacgaggcaccgagcagctgcggcctcggcaaattggccagcggtcgtcccacacaactcgtccaacgagcccagtcgttgtaggagctggcacgccagcgcaacgattacgctattggcgactcaggggacataggccgcaaaccttcggataacaggcccagctatatacgaccagacgggggcggcgatgggattatgcacccccttctttgtcatacctgcaggctgagggtatgtgtggtcggcgatggtcggcggatcgtaaaccaactaagttcaggttagtcccgaatattgaaccatctcctggggttgaataagcagggttggagataagtctattcattagttggtgaccctccacagaagtggcgcaggggaacttatggtatttacctacctcagggcgactttcttcttgtagcaatgacgtacctctagataggttctatgctcggttgcaactgtaaatgaacacccagttttgagcagctagaagcttgatagtacagcagtgcgaagccgtaaatggacgcaccgcgtttctcggtcaaaacatgaatcacacgaactgttaggaataaataaccagaatttttattgtcgacgccgaagatgcaattcaagtcgccatcccaggatatccataaacgccatacatgctctactaactgccacacaacaagaattgtctcagaacctgtttgacagtcattgttagcacactgatcctagggctcgggcacacgaaggagagttccaccgagaggaagaaaaggaggactagggacgggtttcttaccttatttcgtacgaccctgctcttgtcatgtaccgcacccacttgacactggagtagttgctcttctcgaacactttcagatatcggactaggaggccggagctggtgaacatgagcaggctgaagttcaggttgagggggggcctgctccaggcgcgctggttggtcatgctcgtgaggagggcctcggcgctgagcacaaactcgctctggccggtgaaacgggaaatcttccagacgatgcagttctccgagggctcgtacttggccttgccctgggtgcaccgctccgtgatcttggcggtgttgagcggcgtagggatgcggatgacgacattggtggcaaatagcttggggccaaagttggccttgacgccaatgctgtactcgaccttggacttgccgacctcgttgacgatggcgtggaccttgaaggggaggttgacgttttcggtggcacggtagcgcatgagctcgaactcgccgtccggtggcacgaagctgatgatgcggtcgctgtcgaacttgccaagcttgacgcactggtggaactggcagtcctcgagggtcacgctacccgcggctgcctttgtggccttggtgcccatgcgattcccgctggggaggctgtgcaggccgtcgttgtcgaggaggaggcggtcgttgaggccgaatttgcactcgggtgtgccggacaggtaggcgcgcatgatgatctggccgttgacgtctgcgcgcaggatggcaccggtggctgacatgaggaggttgacgtcttctatcacatcgacgaaagcttcgttcttgcggtacttgacgtcggccttgcgccatgatagggcgccggtggcctgcatggtaatcttggacgtgttctcggagcgcgactcgtttctgacaccctcggtggtgatgtacatcttcagcgtatcggtctcggtgttctgggggtatccgaaatcgatgatttctatatagcggtgcgattctgttagctgtgacaatcatctttgaggattgaatgctggtttgtcagctgagggaacataccatccagcagctcgtacaccaggacgaagttgttcttgacagcttcctcgtcaaacttgccaaagtacccccgacctagctgtatcaggcggtagaggaattcgaagacgagggcggcattggcattgctcttggtgatggcgaccaggtagatgttctcgtgcttgacatggctgaaggtggtgctaccaagcgtcaagatgggcgagcgcacctgggagttggagatgacctggatgcggaagacatcggcgaggcgagggcggcagtcgtttcggaaggcacggaagatgaggttctcgcccttttggttgaatatgaggacaccggagatcatggcggttgggtgggtggtgatgcgcaccacgggcacaggcacaggtggagaggaatgtggccagctggtgcgcggcgattgggctggaacaatcggatacgaaggcagcggttccggtctacgagggagcggcgcagacgagatggaatatagggcgatggagagatatgttgcgttgggggtcgacagagctgctacagcttcaccccttttggatggatgggcgaattggcagaggatcaattggtggtgggggagagagctgggcgggaattctgccgttactaagggtctcagtccaccagacaaggctgctgattcgccatttggagcttcaacacggggcgaagtacacttttgaaactcgctatctaatgatatctgatcaagactatctgcatcttccctttaagcagattataatcgctatagaacagctcgcatgatatcgcggagcttgtgcttccttttgcggctgagctgagaccggccacgaaccacgaactgctgcaggtcgggcaggcggtgaggcgtgacagtggactgtgcgcggttcgggaatattattcagcgcccggggctaacggcttggggaattctcatcccagcttcactcagcccgtcttcatagtttgtatcgttgagctgtgaggactgctgtgacctcgattttgctgtaggagagctttacttgagggtcgtgttgttacgtgtgcagagagggtcagcgtgccctctatccaatggggtagaccatgcttcgtgactgccgatgttatgaagcctgaggatgatggtgttgatttggtttctcggggggctgtagcaacgtctcaacaaccgcccgtgaatcccactgtcatcacaacacattgttgttgttcataccgcagtgccatgaaatagaactgtttcatccattgacatgggcgccaatgagattaggggtgattagcgctggcaggccgctgtgggcccctgtcaagtcacgccccagcgagtttgagcacagcccaggctgagagctagtggggatccagttaggaggcggcttgtataattttgtcttgtgcaagtaattaatcaatcgcgtctcgtcgccagtttcgctccatcgatcaaatagatcacattacaccagcttagctcctgggcaggttttgtgtcgtccgcgcgttccctggtggcgtttacgtcgctctttccttctcatctctcgccggtgatgagcttgcgatagcatcacgggaaacttgtgtcgccgcttaccctgcatccacagtccgccgctctcatcatgacgggcatcgcaacagagttccccgcgtccttcgtgggcccctggaccgaactactgcagtcgcacaagaaggaccaggatcacgactttcccaattaccatgtggaccgccctgagtcgctcatcacttccagtgtgcccaaggctctctatgtcggcactggcttgaccatcttcacccgcgcgctgctgcccgccatcctcaacgctaagcactctgtcaactttgtgacttgctactgggcggattcgcctaccctcaactccttccgggagaccctcattaagctcgcctctgcgagggctgagaatccgagtgaagtacctctcaaggtgacgattggcttctcatcgtccggcctttttcagaagctgctgcacacctcctctcgcgatggccatgtctaccctcccagcaagtggcctaacctgggcctccccaacgaggagctcttaagagccggcaacatcgagctgtccgtcaaaagcctgttctttactccctttagtgtcatgcatccgaagtatctcattgtggacggagccaaagcctgggtcccaagttgcaacgtgagctgggagaggtggtttgagggctgcgtcgagttagagggagacgttgtgatccagctcgcagctttccaagacggcgtctggggcacactggcatttccagagtctcgggaagaagacagccccaggaacacattgcatgccacgaaccgatcatccaagagggcatcgatgctcatcggcggagtagagaattctgctacgcagtccctcaagttccccgaaatgccaccagtccctactatctttcttccttcgtcgcatcatcgaaacccacgcttcagcgtcttccccatcctctcacagtctagaccacccatcacgcccctcaacgctgctctgcttacgttgttcaacaacgcccagcgaagcatcaacattgtgacgcctaatgtgacagcgtggccctttatggaggctctgcttgctgctctccagagaggcgtagatgtgcaaattcgcaccagcaagaacatgatgaacgttgagcagatcatcactgccgagactacgacttccaggtgtctggatcgcttcatcaagaagtacaaagctctcagccagcgccaaggagacctggaagcccaggacgaagaagttggccgattggagatcctctactatcagcccctggaaagcagggcgggcgaggaggacgaacctgtgctcagccacttcaagatgacaatggtcgatgaagagtacctggttctgggctctggtaatcaggacagagcgagttggtggacaagccaggagattgggatattgttttacgtctcatgctttgaatggcgtcgcttatgggagggcgtccttgagaaacgtgctgaaactctctttgattccctcgcgccggaacctcagcctgaatgagggttggctgacttaacgtcgatctttcgttttgtttattgtttgatatactactgatatccctcccacttagaatgggtaatcttctagcgatctagcagcaattatttaattaattttggttactcggaatgttgttttctcgctatcgcgcttttttattcttgtcattagggtatactaacaaacgtctatcgagaatgcctgaccgcagcttacagccgagcaagacaaaaaaagagtgccgaccagcacaaacaaatacatccaatcatgacattgtccacgaaagtcgaaatacatgccatgacaaaagtgccttgccctagcctgaagaaggatgccaacgcagtcgcttcactcaccacttgcgcccacgtatttgggatagcaaaggagtaggcacactgaaagtctgtagaacgcgaaaaagaaattggaggcaccagccccgcgtgtgtgccttgtcatccaattgcagctggtgggcccaggcgagctgaccatcctgctgaggcttggagcacagcattggttgggcaatgcatagcatgctgcagttatgacgcagctgagagccccgagaccaaaagtgcagaatgacgaccccgccttgcatccgtccacgggctgcttgggagttcctttgagttcttttagaaatcccataagctgtcccgcagtttgagaaggctggaaaggcgaagaccaaagtcgaactgccgagggcctgcaaagatgtctgggcttgaggttcttggagctgtggcggctgcagttcaactgacgcaattgacggccaagacggtcggctttgtgcggaaaatttcagagatcgggtcccaatattctgacctgtgtgatgaggtatgtttgctagatgggtagagttggtctcttgcacatgcacttacatgggagtgcagatcaatttcattaaagacatctgtgatgaggtgcagaaacactcaagcactggcaacatcacagctggatttctagtgcagaagaaggagctgctggagagtactaagatgacgcttgaggaaatatcgaagcagttagaagtcatcaaagaaaagtcggagcgttttacgaagcagggcgaacctgaagccagcaagacgaaatggatcatcagggaagggaaaatcgccgcgctgctcgagaaggcccaaaaagctaagacgaacctcagtatctccatgaacattcaatcagccattgagatcggggaaaccaataagacgatgcaagcaatgagcctccagatacatgaaatctataagctcatgtcacaaagaatgctgacgcaggaatgcgccgtgattttcgcccgagacaagtcccctattcagcaagctgatgtgaatttgatggggatccgagagtttgaggtcggtgatcaagatcctggcagtgatcgaatggaaccacaggcgggcgaacctttgactatcgccgtcacggatcagaccattggaaggacgaccgcatggatggctttgcagaagaagtgctcttacgaatgccggtgccgatgccacgctaagctttgtcagttatcgatcggaccgctacggttgagattcagaccacccacggccacgagcaaatgggaacggggctgtggctgcaacaagtctgaagtgttgtccgtgggatggaggcttcctggccagcgatatcctgatgtcctcgcctctagccaaacacactcactctacgccctccgccctgcgaggacgattccgtgggcccaagtggaatggagatatccggatctgccagtgtattactttcggagggctttacaatggggaatggtcctgtacccagatgaccaagacgaggcggggcttttgtttgttgaagtgagtaccgtcttataattttgtcgccatctgggattgaggctcacctaagcagcacctcatcgactacggagcctttgagatactcgagctgcttctgactgaatggagaacaattttgcccaaacagcgcttttcaaggtatgtagtgtcttttccatcttatgtgctcaggatgccctcagatgtgctaaattgggcaatttgattagaagcattggatgccgcgctagacgtttaatgagggaccgaaattgcaatgagagccaaggtagactgctgaaacaagtaataaactatacgcaggatggaccggagccggagacgacaccgctccacgaggcagcgagccagggatggggcatagaagaggctgtcgaggcattggagatacaatcacacacggccgatgctctcaataccccggatgagacaggttatacggcacttcatgtggctttgctgaagagacatcatgagtgcgcacgggtattgatcgaggctggtgcagatgtcaatcgacaagctgccaatggattcacgccgttgatgctggcaatcgcgcatcaagacatcgaaatgatgcggttgcttctgttgcgaggggactcttgcagcaagactgacagaagagaaagatgccatgcgaatgaaaagaaccggaatggtcgaactgctttgcatgttgctgccgtttcctgcaatcccgaagctgtgcagctgctcctggacgagggagcgtccgcctcggagcgcgactcttatggctacacccctttgcattacgtggctttgcaagtcggtagtgatagtaatggaataagccaagtcggatgcatcttagaattactgctcggtgcaggaagagcagatatcaatgcaatagatttctatggacagcccccattgatgctcgcggtggctcgaaaccggctcgctgtaactcaacacctcatcaatgcaggtgcctcgcacactagtgttacgacaaaatcagagaatcttttgcatcacgccgcattttatagcagtctagataccttacagcttctccaccacctggatttatctagaattagcgtgcggctccacgacataggtggtgacaacccatgggacgttttcaaacggcgtctttatcggcccgcggagcacgagcttcatggctgtagactaactaaagaagaaggcgatgcttttgtcaacctgttcagaggtattcgggataggaatattaaggatgactgctccctcctgacacaggtactggatagcctctcatcagataatccagctgcctcatgtcgtcatctttccatactgattgagaacaaggaaacctgtggtgagctggggcctgctggattctattcgggtatcaaggggaatatcaatgctggtgactacgagaccgcaatcaaatgcattgaggaggacctgcacgacctccgtgatgagttaactacagacccctgggatcagacctctcgttgggattcactagggcctcttgtttttagatagcctgttcttagttaacattgaaatagcgactctatctgtattcattgtgttgagatgtctggtctggcatcttctattgcttttttcttacttatactccaactctcctcaggaaagcgaatgcatcaacagcgaaggaagcgatgggagctgggcagtatctaggatcaacataaagtacatactgaactgctaggactattaattctcttcgtaaatggaatgacaaacctacagtatcaaatcaagtattgttttcaagaacaattttgccccagaccgagcaatagctttcatttgagccgtaaacagaagggatgcaagtaggtatagcaagagtgaaagtaaacccggatagtttgggacaaaacaaacacaagtttgaaagccatatttttcaccttgattttcaaacaggcctctcatttccgaacgccataactacacacgtagtaaatacaaaatcccccttgcgctttttgatactcctcaataaaagggtcaagcgtcatcaactcagagctcttgaagtgataataattcaggtttggctttgttgactattgcctctagcctgtttcgcagcccttctgcatcgaggcgttcatcaacctctactcgaagtaggtgagcatcgatcaaatcaataaggccccctagagggctattttcgccgcactgggggttactctttaacgatttgatcttctcattaacctttgggtgaacttctaccttgccgttggagtcgtggtagaaatgcgcgaaagtatcggtgtaagctttgggtttcctttcttcgttaaaatcttgaatgctcttccagtcgtggatgagccagattgcgaactccaggtagatgcatcctaatgaccagatatcatatttgcgcgatcttgcccttttttctttcgacacagcctcgggtgcctcgtaggatggtgaggtggccctggtatgagtgggatggtccattctctcaaaagtattgacattgtgaatcttggatatgccaaagtcggcaatcttcaggacacctctaacatcccctgcgaagaagtgaaggatgtttccgggtttcaaatcgccatggcgcaagttgatcttctcaccaatattatggtgaagggcttggagagcttcggcgagaccaagcatctgttccaaggaccagacaagcaattcggacgaccgctcgtcggcgtccttctcctgccagaagctttccaggtctccaccgtcagcccaaggaaatatcatgaactttctgttgccctgggagaaagagccaaaactcttcgtgatatgcttattactacctagtcctcgaatgttgctgaggttctcgcgctcgtcttcaaaatagttgccaagtttaaactctttgagggcaaccgaaagatttggcgcgtcattctattgaagtcagaaaaaagaagtaaaaaacacatgtattgaagacttgcgactaggagggttactatacctggaatccaatctggtgcgccttgtgaatgtttgcctgaaagacgacactggtattgctgtgacctttctcgtccagactgtcaaagggcaaacagacattcgtgtcaaactcgcgatgctcgccattgtttgtaaagactggtgctgtcatcatccactgtttctcgagaaaactatctatgttctgctcagtccagtccttgggtgtcctgaacatcttattcttttcagaagaagaccgtagagtggtgtcatccactttgattagtggaaggtccttgtctgtaaaccctgctcttagcaagctcctgatgtccagggccttgtcgaagtgcacaagggtcaggaatagtttgctcgcttgttgctcaacctggccggcacactttgaaactctcagtggtatcttctttttgcgttttagttcggagccgatatttcccctcttggcgagtttgcgcatcgaatccaccggaatatatctgcggtggttgatctcgtctgaggcatatgcgctctggcattgggagtacagcgtgggaggaggagaggccatgttaagcctgatttgtatctatagtgtctgagaatgggtagcttgaacggtatcgatggaaagagctggctatattcacggctataatcgcagaactgtttaggatccaagaaaggcgagtgtctagtcaacggaagtagctggtgaggggcgaggcgggtgtccttggcaggtttgcggatcttggtgcggcgtctgatgagacctcagcacctacgtaaccgctgcgaggaggctcacgcaaggcagccactctctttgcgtctcaccggcatcccctttaggaccacttcaatcggtggtgggtggtaaaggcgattgatgcataaaatagcgcagaatggctgtattgtcagccgctcgatgcaacacagcaaccactagtcggacgccaccatagacatattggtctggtgagggtgggtgaggggggaatgggcttaatgcctgtttatgagcctttgtggtgtttattctgaccagctaaagccatgattttgcacaggtctttaaatcagctctatggcgcgagggggaagttcggtagatgagcaaaaccaagcacacgactgaatgcactccaatgcgagcggttcaataagcgccttcggtatcacgaggtgagggtgttgaaatttgattggctcaagattgtgagcaatcacttcatcatatgcacctaaagaacttgcataatatcttgtaggtgcgtgggtgtgacatcgtttcgaggaggggtgttgcattttggtcgccttatgagatgcctcgtgcggacgatgcttcgaaccaacgggaacgtactgaatctgatgaacaaggttggccggttcggatgatgcccccccatcaacttaattccaagtttctcgcggccaatagtgtaagccgcgacaatcagcttagccggctatagtgacatcatgcagcagaaccaacgtgagctgagaagcgggcagctcggctgctgatcgatatcaaatctagaacgaaacttggaaagactgttgcatttggattccaagtaagagcggggaggggtcttccggcccgggctcatagcccttcataagaggcatggcttcccgtagctgggcgagaactccagtaaatcgtaatatatcctacctcttatgagcgagaataagaccttcaggtggatttcccgcctcttgccgtataaaagcccactgaaatccaattcacaacaacctacgaccttactcgtagaccccttagaagacgcaactggagcccatctccgtcgggttcagacagagccttcccagccttactccaggcagagccaaccatctgccatcacaaagaagcgtcgagcattctcattcccaggtttggctagcgaccagaaacccaagcgccgaacctctttccccaaagttgcccttcattggcttaattcatctggaaacagcatggcaaacgaagatttggtgggcaagataaaagaaaggacgctagaaattgaaaatgacactgatcaagagacgtacgaatgggtccctttcgaccatatcgaagagctgcttggagacgaagccaatgtaagagcggtgctcagagctgtgctcgagaaacaaccaaaaatgacttattcagtacatgatgatatgacaagattcgttctgggaaaagctaagcggctctttgctgtgcttgttcgttataataaactggattggctaaaactgttttacgacaaaggcttcgcagacgaccaattccctatcgagaggaaatcggtaaaagatctaggccctggctacgtcggaccagactgcaaatgggcagtccggtcaataagacacccagagaactatgttcctttcccagtggaaaaagatgatatagattacctttgccgtttatgtcaatggcatttctttgttccagttttcaccgaagacgacgaacctgtctatattttcagcccttcgcaaattcttccattcatcgaggaaatagacactggcgtagagagcaacttcagtgtcgttaggcattatgtcattcatcccagacatatcgaactccaagacgatcaaattgtaagagataatgacactttttcacacttctctctgttgaccaatctcgcaggtgtgtgctacggatgcccgcgggaatcctcatgttgccgtgaaaaggctgaaattcgcatggagcaaaacggcgggcaaatccaaagagattgccctgaatgaatcgaatgtgttatatcggttcaaagaaaacaggcatcgacatttgatcagagtcatcgcctgctacagtcaaggcagtgattacttcttcatgtttccctgggccccgggggggagcctgcgtgacttctggaaagaatgcgatattttggccgaagaatcactcaactttggctccaaagactgggagctgtacatcgaatggtttctgcggcaactgaaaggtctcgccgaggccatcaaaatccttcactattccaaagataaacccggagaatcttgccgtcatggggacctcaagcccgaaaacatcctctgtttcggcaatcgattgcctgctaggggtgaaattccgacagatattactcttgttatcactgacgcgggcctggctaaggttcacgaaagagaaacgcaagctcggctcgatcctacgacaacgcaagggggcacacgaagatatgcatctcctgaagttgagatagataagaatcacgcgagatcgagactgtatgacatatggtcccttggagtcttatatctggagtttctcatctggattttgtatggaaaagagagccttaaaaaattccacgatgacaccagcggcgactactgcttcgatactcaccctgagcctcgagtcaaacctatcgtcacaaaatggatccaagccatcaaagatgatcccagatgctcatcttcgggacccaccgctcttggccgcctcatcgaccttatcgagcatcgattgctcgtagttgcttattctaacacacagggccaatctcctgatgctgaagcggagtctcaaggagcgagaagttctagtagcaatgtaccgcagatgctagtgactcgagcgacttggtcccccttgtcagacaataagcccatacgagcagatgctgaagccacattaagggagctggaaaagatctacgatgcagcaaaggaacaaaagtcactgccgtggatcaactgggatggaatggcagaagcggcgaagcaagggccaaaaattgtttccaatctcgagccccgcccccggagcccttcggtttccaatttcgacgctacaccaagggtaggttaatctgacctctgcccgccggaactgatagtgggcgatgttgctggcttactgactggacttcatagatgagtgaagtacgtgtctagcccttctacattgactattttggcatttcaattaatgtgttattacgggaagaaagtatgtttggtccatttttcaacatgattcctcctttcagatagttagtctctacgatcatagtatactaacatgaggcagtatgtacgtgagaaaagaattgcggttgtggaagcttgagctgacagatagggttgccttgctatagatggtaatgccactgtgattctctatgaaactgttgctaataattccgttgcttaatttcttcttgccacagtttgtaagtgttttcgatgcgtttcgttcgaaaacttcgtctgacaattttgcacgccagactgtaagtttcataacctggatgctgctaccttgttttcgacaatggatgaataaacggtataactatcaagaagaatgttctgattcattattagcctgtgcgtgaatcccgaaatccctgagacaataacctaagaagaaggaagaagagactgaccaaatttcaaccgcatagcttgataataattgggaatttgaactcgacgataatatggctcaacagattgtcccacagagtgcagaaaaagttttacaatacgacgtttcgactctttgcgatcgctgccaaacgatgaaaatatggtctaaagactttgagttctatgacaccatgtcaagccttgaagatcggtctggatactgtggattatgtggcctattatgtcgggcgatgcttgacagagccgcgagacgcgatgaagtaattaaatttatcagaaaccattcctcgttgaccttcggctacagtcattggagcccgattctatctctgtgcacaacatctggtgagtatttgccgtttggttgtagaccgagctggccaaaaggatgaatgccaaccctataatgaaatagtagactaacgactacgcactatagaatctgagactttgcactcaaacgaggtgcagcttgggtttccttctttagccgatccagggaaggagacccaaatgaaaatagtttcctcctggattgaaagttgcgacaaaactcagcacattcctgatgccggtaccttcatcccgagtaggctattgcatgttggagatatggagtccagtcgcgtccggctgctatgtgacttaggcgaccagattaggccagtgaaatatgccgccctttctcatcgatggggaaatcccgagcagaagcaaccaaaacacgtcaccgccgctgttacgacatttgataacctcggcatgattgcatctcctgaaggattagaccagtcagagcttccaaggacgttccaagatgctatttcggtgacaagaaagctgaatttgaattacctgtggatagactccttgtgcatcttgcaaagaacggggaaggaccgggatgctgaatccagtgctgactgggagaaagagtcaaaactgatggagcagatcttccactctgcttatattactattgctgctagttgcgctgagcataggttcgacggcttcctcaagccacgggcctcgcggcaatttgtaacgatggcggcggatgacggttctctatttcatatttgtgaggtgatcgataatttcgatgcccatgttgaacaaggagaacttaataaaagagcctgggtcctgcaagaacgcgctctctcacgccggactatctacttcactgacactcaagtatactgggagtgtgggcaaggcataagatgcgaaacattcacgaagatgaagaagtaagtcgccacagaaactgaaggctactatgtctgaccacaactctccttttagccgtaaagcatcttttcttggcgactccaatttcccacactctgctgaggcttacaaagaagggaggaaattacagcactaccaagatctttatgaaaagttctccaccttggggcttacctatcccagtgatagaccgagggcaatctcaggtcttgagacgagattaatgaaggctatggactcagcaggcggctacggcgtgtttgagtcacactttcaccggggactcctgtggcatcgcgaactatcaacacccagactggaaagaatcaaactgaaatccgacgataaagtcccatcctggtcgtggaccgccttcagcggagagatacgatatatgaacgtgccgctgggaagattcgaaaagaacgataagatcatgtcgcctttccaaatcgacaagcccactacttcaaatgcatctgagagcgaagctagatcaagcgagatcaaagcacccttgcgtaccttgactgagaaccaccagggctggctgattctggacgacccagaacggaaacgggagaagccacttcactgtatcgttgttgggaaaaatcatcaacaacagcatgggaaacaggcgcattatgttttgctcgttcaagaaaaccgcgaacttgaagcctacgagagagtgggagttgcgtatctgagtgctgaagggctggaaccaggcatcgattctcggagggtgagaatttggtaacatctatgagatagtaccttggatttttgaagaaactgcgatgccaacaaaagaaaaatgtgccttgttggctcttatttgccatttccgcttgacttgctgtaaatgcgagaaaacatctgttatctgtcgacatcccactgatctttcgacttgaaagaatttgatttcatgggcctagttcattaacttgaccgtcaggtgaaatatatgtcattgtattgtgtaatggaatgggcgagttgttcttaaatatagtcgtggccctcgttgccttcctaacattaaactactaggaaaataactgctattgagcaaagaatgcctcctctatatagaataaccctttcaatagcaacataatataaaggaagcaaatacgagaagcttttgaattattcattgttgttacctaaactatttgtttatttagtctatatttgttctattattattttcaaattattgttatttcctattacgttcattgtgttgagatgtttggtctagcatcttccattgctgtttttactttgtactcgaactctcagcagtaaaattcactatcgctattcctagtctactacttaaaaaatgatgtaacagcatcttatttgtttaaagatgtcatgagggaacaaggagtctcaagagacagggattggcttagcaacaataatagacaacaacttgaccaaatcgggccaggcctgcggtgtcttgacacccttttcgaaattgacaatgcgagacattcgaatgtcaatcaagggcttcggcttggcagtcaagtcaactaccccttgcactacgcggcaacttctccaagatgccgaaactattgtgacctaatggatgagctcgattagtgatgaatggatgtaaaagaggaaacaatagagcataccggaatgatgaagggtaagtcgtccctttcgagggcgccactggcaaagatgaaagctaaacccaggattgcgacgagctcactcttcgataagatgccgtctttaagcggattccgatccgaaacgaatgatgtgttgtgtgggaaacgagtgtcgagagcagggggtctcttcgccttgcaatatctcaaaatcccatgcacataccagtcattgtgcgagacttcctgaagaaaggtattctcgttcctatatatgtgtgcttttagcgtgtggcctattattgtggtgaagaggctggaggagaaggttacgtacgggaacatttcccattgggtgaaatcacgcaaaatattgggacggaagaaccccaagatgttatcgctaagataatacccaatagtatcgaaaagagcatccgcctctttgtgattgtgattgagggaatggtcaggaaagtggacaaggttggctacatcactgtccacagtcttggagcccatctgcgtgagccactcctccatttgatcatgaggaacgggctcaagcacagcagctcttccatcagtaggtttaccggaagttaggctcaggccgacgatggtgatcccaaatgtctgcctaagcgtctcgttgtcaagatagggttcgggcatgttgtaggcggggctgagataattaatcttgaaggctgtgacaactgaagccatggccgcacggtcaggacgggattgaggctttggggaggggtcagcgcgatgtccgtgacggccaaggtagtggcggcggtccatggtggtgggtgaagttgattgagaatcggattgtgaggagagaggtagagagtctggtacgagctgcattgtgagtgaatgagcgcgtgcgctgtgtattatgataaaatgacctaggtgagtgcagcaggaagcgcgcgcgtgtgtgatgatggtactggtacgtgtattgagtggcgatgatcaagggtcaaacgtatgtagcttcatcaatctgcatgttggttgctttacctccttggctaatggggtcactggggcaacgtggggcgcgttttgggccaatgaaaccgctgcgcttaggctatacacgacagagacgcgcgcctagcaatctgcatccaaagacaacataacgtaagatgaaggcaaccaaaagcgtttataacagcgacataactggtccattgatgggcaagttgcatttaattaatgataaggaggtggtgtgggcgaggctccgtctagattctcatcacgacgacagcgaactgaagctcattattggtcaccgtccatcaagagttgaaaccctcatgtagacggtcaaccaacaagcgcctactaaataaagcagacgtcgtcacgcatcaagcgtgcgtgagcttgcatgtattctgagaaaatggccagcctgtgtcttgatttgtgcctggagattgatgctatatctccttcaacccgcaccttgaagcttcccaacgtcattctcacgacgcaatcccttctctctctcgtactggatattttcgtcttgcctggattatttgacactcaaaccattcactgcggtatctcttatacaccatcatgagtgtgccaaatgccttgccatcaagcgaccaagcctggaaagatgccagtgacgcacttgggctcgggtcactcagcatccagacctgtgaagcgaagtcagggtccaagattgaatatgagcagttcctcttgctgcgttccttatggcccgagaggaagaacacctccgcactgaacgagtattttggggaggaccgccgcagcactttccatagccagaggatggcggcgaataccttcctggaggatttcacttcctggcgcacataccttggcatgataaaacataagcgcagtctcgagtcgcaaggtgacggttgcacgacaagtcatctggagggaacattcgccacagctctacaataccagcgcctctgtgaaaatacgacgacaactcctcctaaggatgcagatgactttttcaaggtcattgtgtccccgaggagaagctctgggcgaggggggtggcaagccagcacccctccaactccaacacccattgataagaactccgttcaagacatgttgcccaaatttagtgcgctcgatctgtcacccaacactgtctacctcgctgctgagtcttcgcaatccccccagcctatcccacatggccacatatcttcttccgaacagacctttgatccgatcgaggacgagcagatcgtaaatacggccttgctcctatttctacagtccttgacagtccattaccccaaactcggtttcacatggagtttgaagagatatggctttgtgctacgagacaacgggggtcagaaggtctatgaggcacaggttgatggtttgttgcgggacaataggaccaaagagccaaagatcatagttgaggtgaagccctttcttcgaaaagccaactttgccgtctacgccaaaattcggatgcaagaaactgctcaaatggctgcttggattgcaatgcacccaccacctcctagtcatactgtacatcggttagttctcactcccctgcgtgtttgatctttattggtgttatgatcattcttgttgttcatattattgtcagcaatagttcttattgctccaattattgtcaggactagctcgtggctaactaattaaagccgactactagtatcacaggaccggcaagacatctatttgatcgtcgccactttcaacgacgactacgtccagtacatctctcatggaaactccacacccccaaagactacccaatccttcctcgtgatgcaggagtatggtcctttctctgtctacaaccacgatttgatgtcacaattgggcagaatgatgcttgctttgtcactctcgggcggccagtggtgaagtacaagatcagtatccgcgctagtgggtaacattgaaattaaaacactcaaacattaagctgcttattttcaagtctgcgatgggtattatcagattatgggtaacgataatgcatgtttaagaaatagtacggaatatattgttacttatttcattcaatactggtgaatatctctagaaagtagtctgttcatatgaactcctctattggatgccttatttctcctgtcacccactggccgtgttatttaaatttagcagttttcacccacggacacccttgacgattcttcgagagaagctggaagaacgggagaatgaagagatgcactttaccatcctccgcaaaaccagacaatgggaagcggagatagccactgattttgctgcggcaaggtacaagaggctgtttgacgccaggtaccgacagatcgagttcagtgagaaccaatgggtgtacctacggttgcatcgtggctatgttgtcccaggccaaactcgcaagttcggccaacatcgagtcgggccgttcaagatcctgcggaaaagacgtttaactaccacgactggaggaatgtctctataataagacgaccaccataatcaaggtcgcacggctggaggagggagggggggctggggaggagaggagggatggagacagataactacataggtaggccagttgaatacaagctcactctcaaaattacacggcaagtcatctgcagggaacattcgccacagctctacaatgtcagcacctctgtcgcaatacgatataatccggagacggaataaaaaaagcgaaagtattttggtaatgtgctagaatgcagccaagatacaatgtcttcactcgtaagccaatgcgacctcaccgcatgttttttctcattcattgcccttgacatctcgatggctttatttacgtaaggtcctcaaaaatgtatgcgacagaaaaaactagtcagaatgaaaggtagatatgtgagaagtaaagtatcagcgccaatgtctagttgaatcttctgtcgaaagggtgggcccggattgttcattccattcaaaatctgcatgtatttattgagccatgattaaaaaccaagcaaaatgaatgacgcatttagtgacgagagtttcaggtggaaataatagctaaggtgtgccggtttccgcacgcaagcaattcaaatacaagcttcccaattgataccgttaagaagtcagacactggtaatggaagcttctggctgtcgctttacacaactcgatggctgcatgagactgatgaatgaagggtaggtgagccacattcaaagtggggtttgagtgagcctgggatgtggatgagctggtgcggagtcggaaaatcgttgatgcgcatcggcaaaaatttcaacttatcgcttatcagaatacatacacactacgcattctgggatctttcttccgcttcaaccagccagatcaccagccacagagcccaaacgacaagatgcctcagaatgagtacatggaaagatggcgccgcctccacggtcgaaggtaggtttacagaccctctgattttgcttgggcgtgcaggactaatgcgttagaacaggctcgaccaggaggagcgaatgcgcaagcgccaggctcgccagggccacaaggaatccaaagatgcacagaacctgcgaggtctcgcggccaagttgagacaggagaagcgacgagtcgagaagatccagatgaagaagaagatcaaggctttcgaggagcgcgacatcaagctgcaaggagaatccgaggcgcccaaagatgcagtccccgcctacctgctcgaccgtgacggcaacgcccagacggccaagggtctctcaagcgctatcaagcaacgccgagctgagaaggccgcccgattcgccgtgcctctccccaaagtgcgtggtatctccgaggaggaaatgttccgtgtggtcaagacgggtaaaacacagaggaagagctggaagagaatgattacgaagccgacattcgtgggggaggggttcactcgacagaaccccaagcaggagcgattcatcagaccctctggactgagatacaagacggcgcatgtcagccacccagaactgggaatcacgatcaaggcccccatcatctctgtcaagaagcatccctccgaccctctgtacactcgtcttggcgtcctgtcgaagggttgtattatcgaggtcaacacaagcgaactgggcatgacgactacttccggaaaggttgtgttcggtcgctacgcccagattactagtatgccgtcgctttcttcccaatacccattgaccttgtcgtgctgaccgctattctagataatcccgagaatgatggaactgtcaatgcgtgagtcctccccagtgtctacaaagaacttatatttatgctgacatctttgtagtgtgctactggtataatggatgtcttttaggtttggttgggaaaaggatggaatgatggcggtgtcgcattgtcgacaatcagccgaccactacactggcccggctgccatttttgaggtttctgataaattattccacgcaccagcccgtgaagggattgctggttcacgcagttgcaggcgcaagcagtacgatttttttttacttcctccagtcagcataaagaacaaaaagggtggaggactagattaactagcgatgatctctatgacttaaataaactcatgccgctacctacatagcataaagacacgagatacacgcgatgactcccatgcatcttcccaggacctggctgagtggagttaagattatggtgagcttcccctcagagtgagtttcgatctgcatgaggtggtaggagggagtacccttggatagcatcaagtatttttttcaactaccgaaattgaagatgcatattatcattaagtcacttaggagtctagcagcgatcaaagagtccagctcacgaagactactcgactgtattaatcaggcaagatctatcccaactccttcctcaagtccacaagcatcttactcagctcaaacagcttcgagcacagcttcgacgacttcccctcctcgtacagcgcctcctcaagcaactgatccagacagtcgatccggccattcgccgcctccatccgccggcgcatgtcgtccctctccccccgcacctgcgtcacgctccgccgcagccgctcattgtccagccggagaaacgcagaggatgcgtcctggggcggcgtctggacggccggccgcctgctctcgttgccgctgctggtcctgctgtggcggccgaagacgtggcccgagccggactcgccggactcgtctgagtgccgccgggtgcggggggtcgggtagaggtctattgaggaggtgctgacgtcctcgttgggctggctgggtggtgggatgtgagtgtcgtcgatgacggcgacgtcggcgtcgtacatgtatgcggggatctgggaccatgtgtcgtctaggactgtgggtaggtctcccattgggagcatgttgggtagatgtgaactatgtcgttgaaaagttagagatgtgagaagaagagaaatgagaaggtatcacatacagagaagcattgctgaatccatgcccgctgggcgtctgtagccctgacatcgggagtggaataccggctacctgagacgcagggccagacaagttcgacggcgtcctgctctcggagagtggcacataatctatagatatcgtcagtgatgtaaagaacgcgtaggtggcctctcgatacgcacaaggggtgaaacggtagcttccaagctcatcctgcaactgcgcctcggggaggagaatccggaaaaggtgataccaattctcctctccaccacttacaaagcgctggccgcggacctgctgccgctggtcctcggtcatccagtacttggtcggcgacgccttgcgcatgcacccattcttgcggacgtggtcatcgagcgtctccgacttggtgggaaacgaggcccagcacttctggcatcgcaccgtgatgtcatggtttcgaaagatgtgggatcttggaaacgatttagttgaaaactctatcgaaaactttgcgcattttcttttggacttacttgacccttgaaaacccttctgcccctccctctgggttcttccggctgggcatacagcacaattgacacccgatgggatcccatttgttgtacgggcaggcgtacctcggccgcttggactgccgtagggaatcatacggcggtgatatcggttgccctggcgggggcggacggttattcgcctcatcctcgtcactgcgacctggcccctcgttgctggtgcgccgcgcccggctcgcacctgtattacgcctggaagatgttctgttcatggaggaggactggctggaagcttggtgggaggaagatgggccgggatcgtcggacggggcagactcatcaaccgcgaagtcgtttgttgggaagacggcggttttgcgcctctttgaattttggcagtggccttcagggacatgaacattgagcgcatcaagcacacgtttcttcccaccgtctgcggatgagtccgataacggtggctgtgaggatggtacgtctggggccgagctgggcaacgactctggattcgactcgggggcagattcatcgtcgtcttcgtttctgctgagtatccattctagggacctggagaggtgctcgttgatcctgtgctgctcactcatgacgagattggccgcttcctgccagggcgaggggacgcgggttgagacgagcgaagactcgcctgatgagcaagggtccatggtggccatgatgctacgcagctcctgcgtggactctacataagcgtccgtgtcaggaagccgagcgtcaaatgtagtattttctggatcctcggggattggaggaggaaggctaggctctgcagaagcctctacctggctgttgatcaaaggttcgtggatctcttgatcgtctttttcgttctcggcgtaatggtcgaggggtctttcaggcgatcgtgaagtgacagaccaccggaaattatttctctcgtcaccaagctcttggcagtcttcagggaagtggtcttggacgaacgactcccactccccgaccaggtcgttgatctcgatgccgctgtccagagattgcgcggaagcaaccgtaaacgaactgccaggttccgagcactcggtcggggcgaccagactcgacaagccgctctcttggcggacgatacgagggagagaaggatactcgcattgtacacccctcttgacgcaattcccacatgacggctgtgtttcttgacactatgctctcgactgtcagtcagtccatcaaccatacatgcaatgagatggagtaacactcgccttgacgtgtctcatcttgcagttggagcatcccctgcgaatcttggtgtgcggccggcgctccaacctgggcttctccatgtggccgggagcaacttcggtcgtcacactgcaagagtcaaaggccggcgaggtcgcacgcagctgctcgccatactcgtcgtcttccaggaggagaccgaagctccttggcggatggctcaggtcgccgagaggggatagtggcgggatggtgatgtaccccgagtcgcagctgtccaggctcgcagtcgacctgatggatccattccgggtgagctccgacgagctatcgggaggaacaagatggtccttgtcgaggcggcattgccaggcgggcttgtggtcgaagaaggtgtcgttgacgaactcacggggcagcatgtgccagccgagacggtcgttgtggtggggggagtggtgatggctctccattgtgcgggagacgcttatttccgggcatgtgaattggcaatacaaagacgaccttggatttcaggaatgcagaaagagaatggagggtcgatcgagcagagcagagcacaatgggtgttgcctagaccacaccacataaggcgtctctcgtgtcgtgcgcaccatcgtgctcaccacagtccgggacctccacgccagaagatgccggctctggggaagaagagtgcccggatgtgcgagctagactcgtttggggaagcatcggcggttcagctctcatctgcaccctggtttagacacttatctggccgttggtagctgttggttaggcggccaagggaagagtaagccagggctgactggctggcttaccggcgtgcgtcatgaacctgcagctgtgcatgatgacggtcaaagccaatggcacgtatagccagggcagcctataattaacataccgcagggacctaatcgagcttgccgggacctaatcaaccaaaggcctgggacaacgcgatcatctaatacgaagtggattggcagacggcttaagtcccggtggcggtattgtcctaccaccccagaacggctgttattaataaacacatgggaggcaggcctatctggagaacttggcgtctatctggcgtgatgtcacatttgccaatatatgcatggtggttggctccgggaggctttaggcagccattggcactcgacaatcttgcgtctcatgcacatacacatacagacgcacccgtcagactggcactcaggctattggtggtaatactcaatgcaaggagtgccgggcaacgaaccagggccatccacggcctcgcaattggctccttggcccgccaggggtctcggaccagagccaagtcgcccgaagatgacgctttattggaatcccgcagggcccaatggcccctggcggcagttccaaaagccctcgcttgatacaagcataggcagatgtaagcagaagtgcagcagcatcactactggaacgaacacgcgtcgtcagtgagaggcagaaggctgccaagcaagagaagaaccggtaggggagatctgaaacacgggctgttcctgaatccgacatgtgcacatggcaacagctctcgcttgtgctgtgtgtttggttgcattgcccgcgccgcacacgagtgcggacacatctgcgccgggcgcaaacattgattgtgattgatgccatcaccaagtgctgctctcaagatgggcatcgttgctatatattcgagggatcccaccaatatccaagcatgcaagtcaaacataattatctcgttcaattaccagcgtacactgtagcttgctctcatacctcctattgtgttacattgcttcttgagcccatactacaacaagatacacgcacacaagcacacaaacatagagacagacagacacacatacacaaacaagcacacatccaaacagacgcatacacacatacagactcatccataatgagccagccagcacccgtccgccggggcaatccccagcaacaaagcgccaccacaactgtgtaagtctcattgccagcttcaccaatcatccacatataagattgaacctaacatcgatcttcctcagcacttacccagtcagcaatgctgccacccaaggatcatcgcgggacgccactggcttgggcacacaatcatctcagtatcaatatcaataccaacacatcccgaccaatggcaactttgatgtatcgtttgcgggttcccagttcgcttagtaggactgaagggtgaaaaacatagatttagataagacatatacaaagcgatcattacaatttccccatcccagaatccaaacccatgccatgctcccagccataatacccataacccatatatattccatatcccaaattgattccaaccctcctcctcaggcactcaccccagtcagtccgaggctgttgttatgccacggccgagtgatgatcatcggcagcgctgcctctccgcgactgcgcctccaccggttcgtcgactccatcagctcctggcaccccatcagcgtccatccccatttccacacaaactcgggcgtcacctcccagctctccacccggtgcggcgcgccatacacaatgaacccaccccgcggaggcgccgtcgcctcgtcctccaacgcctccggtgaaccccctccccggggcgacgcctgcgaccccttgtcgaggaggtgaccctcgggccggaagaaccgggacaggtcgatgagctgcccaatcacatcgttgaccagctcggcatggtcgaactggtgctgcgcccggatgaggttgtcgcgcatccgcgggaacggcaacaggtcgatccacgtcgcgtgccgcaccgtgatctgcagctgcgtcggcagcagcgagacgggcagctcccccgccgacaggggcacgaggacggcgttgcccgggtacgtctgctccaggtacggcacgagaggacccccgtcggcggcggcggcctcctggtagtgctgggccttgcccgacatggagtacttgttggccacgagggcgcggaacacgttgaactggatcagctcgagcaggtggtccgccgagacgctggccgagtacgtcttgatgatggccgcgcgccccgagcagatgcacacgctcacgtcaacggggtggtccgcgaatgggccgaagatgggcgccgccgccgctctcatccgcgctcgaggaggctcgtcatcgtcggcggcgtccggcctggccttgcggacgacgagctgctgctgctgcttcttctccgtggcctcgccgttgctgtagtgtagccgccagcggtccacctcgtacgggcggtcggccttcttgtccgtcttgtcctcctttaggcgagatcctgttgtcccccctcggcgattagtaattgatgcttgtcatgatgcgatgcatgtcaagacccactgcgcgctctctggttgagccggttctgtactttcttgcgctccttgcgctcgcgtatactgtccgcctcctgcgttgcctccatggtagatgcggttcggatctggagagatgtgtcgacgacagagtcgcagggagacgggcgagggcggcctatttggggcaaaaccgtcagcccaggccaaagaccagggcctcgacgacgaacccagagcttttgcctcattgggcctcaaagccccggttaactttgattagctgggagactaggccgcaaagagataaaaatgtcagccggctgtcgtgaagcgggtttagggatcgccaaatagtgccgatatcaactataatcccgtgggtgtccggccgagaaagcttgagtggcttaacttacacggtaaaagacatcactgaagaatgccagacccaatataacaaataaaagtggtaaaataacaagctttattaaggtagtccaaggttgcagctttatccagtccacacacttcagcaagctcgaatatcttcgcacatcctttccaacctcatcacccagtgagcaccagtagcatcatggccagagcacgtatacttaagaccataagttagttttcagaaactgctttgctcgctttagaccatagccgcagcggccgcagctatgccctgcatctgggagaaagacaagttcatagatcttgtttgctttattaagctgttgaacaaatctcatagttgcaaagtggctgacagcatgatctaggccaccggcaatgagcattagcttcgcgctgtctgggagctttgcagcatgcgtgacgttggagtgctgcgaataagactcattgactgggtggcctaaccactgctcggcccattcgataccggcaagactgttgtcgtggcatcctgaatcagctacagcaaccttgtaaaagtgcccaaagtgaagtagagcagatgcggcattttgaccaccagctgacgagccaatgatgcctactcgactgatatccatccattcccgagactctgctgcttttgtgatccagatgatccgatctggaaagcctgcatcattgagattctgatagcagacatcatggaacttcttggaacgccagttggtacccatgccgtcaatcctcacaataacatagtcttcttccctccaatcgcggttgccatccaccgcctcttggaagctctttggagtggagaagtcctgcggccccgcatagatgtcttcaagcactgggtagctccttcgtgggttgaaatgtgttggcttcgtaattgtgccatatataagagtctctccgtcacggccgaggcagtggaacctctcaggaggcatccacccctgctgccgaagctcttcaacagaggtaccttcgacctgcaactgcatcgtcccatttagacagcgtaccacggtctgaggtggaagatcaacacgagaccatgaatcgacgaaatattgtcgtaactctccagacgaccaactccatagatgggttccatctccttctgtcaaagccttgcattccgtatcataaagcttggcttgcactagatgtctgtgataaggatcctcatccttatagaacccatacgtagaaacccaaatctgatttgattcttcgtcaatatgttcaaccatatgcacattccattctcccttggtaatttgattctctatcttgccttgttctaagtcaagtagatataagtgattatatccgtctctctcactcgctagaatgagcttgttagagttggataggagattgtaataaagctttgaagcgatatcaataaaggtgtcactgctctcctcgtataatactcttactagcccggcacaggtaatacccaagattcgaaaggtcttatgacctcgcccatgatacaagaaccgatattctgatccatcctcagcccagcctagatgagacagctggtagtggtttgagaataagtccttatcagtgacttcaatttcctgttttagggtcaggctgaagaggcgaggttgttcaatcctggggcaatccccagcaagtctccgttcatcctttagaagttttgggtgagattgggtatgagggtaggatttgatccaatgttccgttgttgtggttccttcttgaaaataccatgcaattgcgaacgccttgttggggcacagaaaaatcatcttgtcgttccagtaagactcttcggaagaatttgcctccgtgagttgggactcgactccttgttcatctaggagccataatatcttatctcgaaccgaaatatgaggggcggtgcttatgtcctcttcgcttgactgaacaacgccgtcgtcgtcgtcttgttgcgttttacgatgttcctgcacttgagccacatcaccctccccaagcggagcaccaatgggattttctccctctttgcccaagtactcatcaacatccacctcgtcgacgatgacagtgtcgtgtactttgtctggtacacggtataccccacgcaattgacgagacactccgtcctcaagcctccaacaaaccccagagtaagtcttctcgaaacatgtcttgccttgggagatggagccgtggggtctcacggttcccttatgatcggcatagttgagaagcaaatgagaccttgtattattgataaaggtgaccgtaacaggccgactagttgcggtatgagcagaaggctcccgcctgcgcataagtgtcgggtttccctgattgaatgttcctgaacacctggacagacctttgacaggctcgaagcgccagatctgctcctcgaaacggaaacggacgtgggaatcctcgagttcgatccatgaaaaggggagtgcctccggatcaatcttggtctgttcctgcacatgctccgccagtgcaacggccagagcctcgtgatcaaagacagggcgagtacttttgccttgaacgtcgacgtagatgaatttgtacttgccatcgctcatttgccgacggtaccagaatgcctgacccccaggaagccagtgcggggcgacgaacgtctcggcgaagcacctctccgctgccgtgggacccatgagtatggtattatggtgggtatgtctgggtgtagtgtgacttctgtgcgtggtatgattgccacttaatgaaggagaatggaatcaatgctgggccaacagaggattgagaccaagacgcaggaatgatgggcagagagggtgtctagggctacatagattcttctgttggtgctcctcgcatgcgcggttggtgcaaaaacaggttatccttgcatgtaggatgtaggctgactgacccataataaagaatgcactcccgaggggatgcctaacaattcaaactaaagggaaggaagggagttcccttgagcatagaagtaaatcacaagggtggaaacaattccgtgagaagccgtatttggcgggttgattctagtcggctcccatctgagatgcctatgtggtgtttcccaatttgagactgatggcgaattactcatgataatccaggagtcacgaggaacacggttggcctgaccaacagacctttctgtaacatccgtgccccataggactaacttacgcagcctctttagaacttcatttcctgcgcttttccttttgccttggtggaaagattaaaaataatgacgcggggaaccgaatttagcaatatgttgcggctcgcagctcccaaattgaagtgttctgacggatggtgcggatgcctgatgcataaaatcataaataaatactagatctaacgaaaacgagacgtagctaccggtcaacatgcagttggtagcaaagtgacatgctatcctggtagttcttacaatccttagcaatctttcgtagcagaaaggctacagccggcaatagagcgcgtgctgtaaatggcaatgcgagtacgcaggcttacttgaaccctgcaggctgttggctctaacccagtcatctcgcacaagagcacttcaaggtgatgttaacaacttgtgggtgtttgcctctcattgccagggtcgaccagttgggggcgcaaggcgtctaagcaaggacgcgaactgagggccacattgtattgaacgaggcattaaacatgacgcttttttaagaaagctatatataggaaatgtaggaaaaggatataaaaggacggcctctctccaatctgtctaaccactgctcatgaaaaaaccttaacaaactttaaaaggcaccaaaatacattactttccttactatattccttttctttcatatcccttttcccgggggagagcccatctcgctttttcagttccgctccactccaatcccaacgggcccaaattcaaaatggtagccgtcacgcggttgggggttgctcttcctctcctcttcagtgtcgttaccagtggtgcggcttcgtcccctaacaatggccacgacgttactcgagcagttttggaagatgaagcttacgaaaattctttctacgaacgctctttaggagggttcgatgagcgggaccttgaggacctagcggagcgtgacgatgaagttctatatgcacgacagaacccagactctcgcattgctgattctccgcctcctattcggccgagaccgaaatcccagaggaagtccaggcgccctcgtgctatacgcctagcagaccctgagccggcaagtcctctacctaagctgggtggttccaagaagaagtccaagcgcccgcgtgctaaaccttcgttccctaaaataaagcctggatcgccaactccatggcgtaagtttaagcctgggtctctgcctgggtctctgcctgggtcgccgactccatggcgtaacttcaaggctgggtctctacctaagccgggtaatcccaagcgcaagaataaataagggccgtttgataccaggagatcatgctgccggtgccttggctcataaacccncccccctttttttttaactggttgacaaattgtggttgccatcggcttgaagattcggcacctgtagcttctccatcaactgaagcgttttgcggaccatggtgctgtttcatattgcgtttgttcctaggacgcgcattattatgttggagattacaatgattggtggccagagttgggattagtattagatctactcctccaatttggttttaatcctgctcctatactatgacagtaaaggataaaggttttaaggagaaatccttaggggtagtcaaatacatgttattatacttacaatctttatagattagagtccagatgctggtgtcctacgtaaaattatttaacctaacatagggcgaaaccatacccccttagttaatttcatgaaatcctagagtgttgtttagaaaaggaggttgaggttttataatataaaagtattatggttctaaacaatttatgtttatgttcttaatagaggtgttcttgatagagatgctcttaatttggaagcgttatacggagcgtggttactgtaatgaatggtggtagaagaagttttagtactgggtatgccccttcctagtagattgaaaagtaatttgttatttcataacgaatgctctgtaaataagtctatgactaggccgctggaactggtctggagatgcaacctcggggactattgcccggtttaaatcaccttggacacgctgcctatgacgctactgattctgggcaccattaatggttagggaaaatatgggtgatctgatcgtgccggctttgcctacgcaactcccaaaatcgcatccacgcacaggcggacccgaaagaagactgtgtgcaaatgaagcgaaagttcatgacaaatagaaaggggccccatgagtaagggtatagccactcacgttgatcttgacgattacaatttagaacgtcaacaagcttgtttgaggaatcctcaaatcccgaagaagtatgcccagccatactttagtggctctagagtgagcgaattctctcacttgagaaaagagtttgggaggtggctttcagacgatggggcagtgaatcaacggatttcaagcatggggatatagaagatggtaagaatattggcctttctagatgtttcttagataaataataggatatatcgccagatttgtgacatgatatactgttgttttctgcgactgtattttcctagccattgtgggaattctttgcttatgactgctctttcattctcccctcattgcttcagtcacctagttgatcggattcacatgggaagatttagtctccgaggctatttacagaaatgtctccgaagctgttcacacgaagctgctcataaatatgtctccgagcttgcaaggtcatatttgctcgtgggccaatagaattgaagcatgtgcctctttggatgcagccacgctgcttctgaggaggatgaggcagtttcgattggccagcgcttcgcctaagtcccacattgatcgaagagaccaccagcctccttcttatactcggactcttctccactattaggggaacaggagtgttgagagggcgtgagggtgatataaaaggacttgatcatcagttcatgcgatactgctcttcatgtttgtcaaaatatcttgttaagtactacttaatgatatagtattatttggaaactaggggctccttgcaagagaacggatatggacaacaagaagatccaagacacgctgcgcaagcagtatgatgcattatccacactagacgatgaaggtgtggataggatgatccgccagtcagaagagtttatgggcggaatagcacggctgttgctcgagcaggctggccttggctcggggaccacaacgagctttgacctcatcgatcacgcttgtggcacaggaccgatcgctgcccgtctgcaagagatgatccaaccagacgttctgcggcagagcaggattctctgcgcagacgtcaaccaagcgtttgttgacattctcgctaagcgtgtgcggaagctccactggatgaacgttgaaaccaaggttctggatgctcaggtatcaacccaatccaatactgagagagataaacgagaatgagttctcttttatggataccttcgattgatctaaccagcaagctttaggattcaggtatggctgccggccagttcgactacatgacgctcaacttcgcattacatattatcccagagccggaagccgtgctgcgaggtaacctgcccccaacctcccaagacaatcagactagctaataggcattttagaggcctgtagcgtcctgcgcccaggcgggaccctcgcattcagcgtcgttcatgctgataccggtgtcgcgggtgggtgggtgcccgatctacggtcaacacttgaaacactgcctttcaagactcctctcccgagcccagtgcagatggcagtccacgggaagccagaatgggttgacccagaaggcatcaagaaggccctgtcggcgcatggctttgttgatattgtagtaaagacagtcagcacccctcaacacgtaaaagatcccgaggagttcgcgacgaagttctccatgattttcaagtggatcatggacacatattggactgaggagcagatcgcagagtatcaggctgggtttcgggacagagtcatagatcacctgattgagaaacacgggaattccgggtgggacctccagggaactgcaattcttgcgacggcgaagacgcctcaatagctgccagaatttgcataagaaagaacatagctcagacgagtgtttcgacgtggttggacaagtacatccggttggcatgcctcctaatagtacatttaagtgggcaggacggatgagagttcgagtataaagttaaaaacagcaatgaaagatgtacgcgaattccaccatttgctttcgtattgatcatgttgtattggaattctgccttatcctgtatgtagggcgagatgtaggatgacaaggacggacagtagattattatataagagtagcacggccctctatgattttcttgaggtgggaaagcagcatcgaacagtgcttaggccttgaccccggcaactcgagttgtaaccacgtctttgctgtcagtagaggcatcggcctcatcatacgacgaagggggctcatcatcgagatcagccaaacctgtgagactcgttccgtgcgacgtctcggagatccctgtgtatgccacccaaccgagcccaggagcggatatgaagaacagagcaaggtttatggcgcaggcgccgacgaggctgaatttcttaacaccaatgacaaagccgaatgtcgaaccaaccgatccgatagagttgatcagagccgaaaggaatgcggcctcgttcacattattggttaggcttcctgcgatccagtacttataagtcgtgacactaaaaattacagttagagttttgtaattccccaaaagaacaaaaggttatcgggtagggcttgagattccaaatacgtacatgggatcggatgcgccccaaagaaggaacacaaagcagccgagcccatactcggtttcggcccagtcaagagtcggcgtggtctttgcgtagtgaacctgcacagcctgaccgataatccaggacgcgccgactgagaagaacaacaccaggaagccgacgcgggccctggtcttcctggagaatctctgccagtcgaggaactgccccaggagccaggaggcgaggaaaccgctgatatagaagagcatggagttgagagcgcgagatcggacagtgaaataggagtaattgaacttccactggtaagcgaggaaccactgtgcgtacagcatcattggcatcatcgcaagcacttttggctgtttgagaagcgcccagaggattttgaactcgctaagaatagacttgctcttttttagaatgactctgcgtccgtcactacgctggactctgtcggcggcggggaggaagagtgagaagggcagtccgatgcacatgatgacgatcatgacaatgtaggtggcattgctgatggagccgcgatagtttcgggtgacgttcaaggcaagactgataatgccgccgatggaggcacctagattctgtagcataaatttcaaagatgctttatgagtgtcagctagagggtgtttcttcgtttcaatttcggaggcgacaaatggaggaacctactcgcaagacccttgcgatgctcttcaggatatcccatgaagatggcaccgctcgctacccaaagaaagcaggcagaaagaccgcacgtcacagaaccaaacaaaagaagccactcctgaccgtatttatcgacaacgaagaaaccggcggcgtaaggggcgtacccaagagtgccgatctggagaaaaacgttagcacaacacaagatcagcttctaatcgaagtgtcacaggcctcagaacataccaccaaggtccatttaggggtcagccacccacagactgcaccaacaataggcgatccgagagcaatgacagcaaaaacgacagcattggctgcatctgagacctcgggtttcgcgccgcctccggcccccataccgttgagggcgccaaagataccggggcatgtgaaagcagttatggccacaatcaaggccgaaaaaatggaagatcgataccaagtgacgggcgctcggccctcttcagtcgtaaaacccatggcgacaaaactggccgggaataacgattctaaggggataagttgtggttctattgaaagcggacacttgacaactgcgagttcatatctcagcagaaaccatttcggaaaggatatatagcatggctttatgcctccgagaagaagctcttgaccctgtaatggcaacgctggttagatttagatctccggattgcgcaactcaggtctaagtagatatcagggactatttaacagaggcctgactaggttttgcacacccaccggatcaaagagtggaacaacgcgagtcagggaccgttttaacaggacaaagacgctcaatgcaatgatcaagggtccaatcacgcaagaggcggggttggcaaataaacccagcgttccagtgcgccggaacttcatgtgagggtatcgatgccttcgtaggggtgtgatcacgtctttccgggaatagatctcgtcatatttgttggaatcgatagcaattggccaatgcaagagacaactgaaagttcccgttctgcgattgacgggatcaactatcccgatatgctcacgatttgagacttatatggaatcacgtctttgcagcttggacgtacactcaaagtccttcatcgaatttgaattctccaaaatctgacccccttagcattttcgcaaaccatggtggacctagttgtaaacaactcaacgaatcctggcaagctccgcatagcgtatgtgaaggaacacaccccagtcttaatccagcaagctaacctttgagttttcaagcatcgtcggaactggtctcgtcggaagcgcagctctcttggctttatcgcgactccaggatgtcgaggttgtgggtttcgaaaagtcaccagtgcctcgggaggcaggggcttggatcagtctgaccgtaacaggccagctggtactgaccaagctgatctccccggcgaagattaatgaaatagtgtatcggccccctgaccgagcagtctacgtgactagacactggaggactggcgaagacttggtcaggcagtattcttcggaacacatcaaagaggactttatccaagctcgtactcaccgatggccgttgctgaaacttttgacggatcatcatcccaagggtgctgttcagtatgggaaacaagtcacgggcgtgaaaaccagtgaagtgggagcaaagttaaagtttgcgaatggtgggaccacttcagagtttgacttggtggtcgcggcagatgggatctactctggcatcaggcggcaatattggcccgatcaccaggttcagttcaagggcgccgtggcataccgcaacgtctttcataaatcaagagttgcgcatatcaaggagcttcacgacgactcttcatcctggagacgtgacggcgaggttgtctttttgtccgaactcggtctcgatcagtacggagtggtcatcatcaaaacagaagagccagattacgctgcgtgcgccgttcctgttgcgtgtggagcagcagatggcgatagaccgagccactgccaagtatctggctgaagcagccagaaatgaggatgagtggaagcgtcgattcaaggagagtggagcaagtattcggtggttacaagagcacgatgtagagctggaggttttgaaggctgtttcaacagttggtgtgtagaaaacataagtaggacgagtgctgctttactattaatcttctatagctatatacgtatagtaaatcccccttggtaaaatagattttggaaataccgatacaaataaacctagatgtgaatgaaatgatagtcaggatttgtcttctgactggatatcaagtccttttccctactcatcgccctgagaccagatccaatgccaaggtgatgctatgaccaagtggtgttcactccaactacgtggatgatttctagtgaaccaagaagccgggtacctttttttagttagcccataagcatagatgtctagtcattacattagagatgaacccactcctcgagtcagcctcaatgacgaatttaccatctagatctgaagcccgccctggcatctgcccggaattatgacccagtgacggataaggcaactagatcaagcccgctcggcttgtcaaacaatcatgccatgcggtgtgcagctgacgttcaagacgccgcctgggtatatgttcccccaaaaggaaacacggcctgctcacaccctaactgagagctatttactaagggcccattaataattacatgccagttaaacctggcatctcaattggtcatgataagagcgttattgttatcctcccagaatggggactggggctctaggtcgattgcgtagttttctagcatatatcgcaattcctttcatgtggaaagtgggtactggcgtactgagtccaggtcactcagagttctggcattccttgatcttagtttatggcctgattattggcttaattcgcgacatgaaatacgattaatggcagtcttccctgtcgacatctggtttcaaatatctgttaagctgctcgttcgaaatatattcgcctacagctgattatttctccggcttcaaactaccgaccatctgcacttcctaaaattgataattgccttgaactctcgtttgacacaatgacgaatgagaagccacaaacacccatcaaggttgcgattataggcggcggcccagcaggtctaggagccgccattgctctatcacggctcccctttgttgactggaagctgtatgagaagaagccagaaatcagcgagattggcaacggcctcaccctacaaccaatcacatggcgcgtgctcgagcattttggagcgtcccatcatatcaagagcgacgacatctttaggcccattgacggccataacaccgagcatcggtaaggcaaacccccgacgctttttgtttcatatgttaaccaactttcaattagtaacggtctatctggagtgttggaagccaaagccgccccaaaagaaggcgtgccaccgcaccaagaatcctgtagggctcacaggtcggttttgcagcaagcattgttgaaggaggtcgaccagagccgcataagagtaggaaacaaactagagaaagttgagaagctaagttcggggaaattacgcataacgttcgctgggggattctcagatgagatcgatctacttgttggtgctgatggtatccgctcagtaagatgaagccgacatcccctataagaagcagtgatgggtaacatgggctgactgtttgttaggttgtgcgccaattcttctttccagagcatcgtatcgcttataccggctcgacagcatacagaacgctggtaaggacagatgaggccgagaaaatcaacggtctgcccaaggccgtcattttctggcatggaactgacaagaaatgggtttacacttgtcctcttggcggcaacgactgggaaatcacctgcgccgttgctgagcccggcggtgagaaccgctcgagctgggggaaacaagtcagtgtgaagcatttcaccgataccttctcggagatgtgtcagccgattcaagagctcttcaagctggtcacatatgtggagcagtacgactacttcgcaggtccgagactggattcagtaacccgtgatggagttgcagtcctgattggcgacgcttcgcaccctctatcgggtgcgtttggggccggtgccggtttcgcgctcgaagatgcatatgtcctcggccaggcattgcagtgggcaaacgatacccacagagagcttaaacatgctttgcaactctttgaccaggttcggtctcctcattacaacgccctgtataaagtcctagacgagtttggtgagacggaaaagcatctggcgcaggctgggctgaaccaggagcaggagatcgctgaaagaatcaagagaaactgggatcataacgctaattggatgcattactacgaagtaggttataacacaatcctctccttattgctatgattgctaatagatgttctaggtggataaagtatttagacaggttctgtcaaaggtcgagagtcaaactgcaaagttatagatagatatatgttgaggtgtactttagacctacggcatctctctcaaccacctgccacttttagattgacggatgagagagttcgagtataaagtcaaaaacagcaatgaaagatgctaggcttgacatctcaacacaatgaataacttgtggcttgatattagacgtcagaccgctacccacttacaggaccgaggcccgcaaaatttaacctaacaggctacattaattagcaactgcggaaaccttcttgcttgaaatcttatctggccgtctattttgacctgctagcttgcagcagctcttgcatgtgtatgcggtctagctgtctaatcgaccttgtgaattggctgtggcttacggaggcctcttcgggtgtctatgatctaactctccagtttaacctgcttgctagctgctgctcgagatagcctctgcgtgtgtgcgcaatctggctgtctatgtgagaatgaccttggtagagtgtgtaagtcaattgcggtatcggatgtatgtcacttgttaagctacaaatggcagtaaggagagacgtggttggtgtcaagtgtaactctatgtgatttacgtttgagttctgaattccaaagcctaaggcacattacccttttggcccttttagatacttcaataccataggggtctctttcagaatccgtaaattctgctggatgtgagtcagggtgtgtattgtagacaatttggcgacaaacatactatatatatatatatcgcgaagggatccacccgggcctggaacacaaaccgatctcgggtccgtcatttgtttattttttttccccttggtctctgagtttggagtaaaaacccaagtgatcatgagactcggatatggacttaaattcccgaaatttttgggcgtttttccatgcgtatcgcgtagaccgagattagagccacgctacactggcggtccgaaaacctttctttttttaaacgctggtagcgcgacaacacgaattctcttctgaaactgtatgcatgtcgctaccttggcatatgttatgaagttaatgtaggaaaaaagggcaaaaaaaaacccatggaggaaatctcccttctttgtctcccttactcgtctcccttcttcgatttccattacggggaacttccatcctaggttccattctacaagctaatttggtatcgaaatatagcgactgcgtaagtcccaccatcattttcataaacaaataaaacaaagatcacaaaataaataatgtcactcactttagggaaatagaaccacggaggctgcggcttgcttggacatggacagtatcaaatgcaattgccacgatcggaaatggctggagcctggagtccatgaggcgaccaagcccgattgagaggaaagtcagacctttctggtgatagtaagagtgtgtaagtttagatggcgataaacctttctcggcagcccacgagggcaaaaagggtctaacaacaagctcaagggcgagagacgcccaattacgacaatattgcgtttgaagaaaacttaagaaactcacaaggatcaaagtctgctccagcttttgaaaagcagaagcaatgacaagtaagtataaaaggccctcattcctcttcaatgaacatctcattcagcaggctcatctagggaaacaagaagcgagtgcaaaagattcggagggtttaatcgcctccgactctaataacactcatggcttctacagacgacgacccagatggacatggcggcgatgccttcaaaactagggagacccctgccgctgatgctcctgggctgttgacttattttcatctattccctcaattgccaaccgagctccgttgcaggatctggaagatggctgtctgcacggagaagacaccaaagattcattactactcgctctacaatgacgacaacggataccggcagagccgcctgccggagctgatcgatatgtatatgaagccgggaccgaaagactgggtatttaggcccgtcacccctcatccactacaatgcaagccgcaacagtatgattgggccgatgataatcgtttcctaagttactggaatgctggcctacggactgcgtgttgggagtcccgaacaattctcatgcgttactacggccccaggccaagaagacagaatcccttcgccttcgtcaacaagcgcccgtacaagaggaggaagaagaagaagaagaagaagaagtcttcctcaaccacgaatcctgggaagatcgtcacaatacgcgaaaaaaaggaaatcatccacctcgacttctccaagcgcgatattgtatgtttccgattcccacccgacgaaatggctcgctgcgtcttccttaaatgggaggaactactcacccgtcttccattctatcatcttccccagaattcagacatcaacctcgcttttgaattcgaccacagttggaacgagggcttgggaataacgaaggctggtgttctcagaaatctagcagaggcttcggcaagaggtctggtcttgagagccttctgggcatggaaggtgggagccattccacgatggactcggctgtacctgattgatcgagcagagccactcccacccaaatatcagattgggaggaactacgatttgcggtacgtgcccagcttgaagtatcacagagaattcccgtgccagcgccgagaaagccgtgtgtttattgatggagaggacaagtatgtggaaagctactcgtgggatcgcgatggtcagaattgctacaatcgccatgtggaatctgtgcctgtagccgcatttatgcggacggtggaccggtatcatcgcccatcgccggatgatctgtgcggtcgtgaggatcttcccttctatggtgagatcttcttcagggtgttacgaccggtacccaggacagaagactaggtcatggaggccggtctagaaattttttttagtattagtataggaagaaaaggcacagacgaatcggtcgaggccaaaaaaaaatacaaatttagagctcaagctcgacttgagtctcaattgcatagttctttgccagataccgcatatttgactgaagtctcaacatattaaagcccccttcaaaccttggtcacgattttcgtcaaatcaataagactctttcatcttaacgagtcagatcctgacagttcacagcaataatgggttgtgggatggtcaattgagtcaagatggcactggaatcgcagctcttggagtttgctgacgagtattgaagcatccaaagaaattttcctctaggcaaccacctatacgtgttgtacctggatgctgtgagtcacgatggaacgttaatcaaatacgaaaaatcttagaagacttgactgttagagtggcgaggcagacaacatcttaccatgatatgctcacaaggtcatgcttcggcgtgaataccctacacgtatgagaaaagagaataaagttcaacagcgatggaagctgccagagcccgagaactcaacacaatgagaataccctacacaggaagatggctaatggaagacagtagagcctgacatcctgagcgattttcgactaaaaacaaatagcatcttcccccatacacccctttttttgtccaacccagccagaagacgtttttgggggtcacatgacacttagccactcgtatttattgtgttgaaatgtcgtgtctggcatcttcgttgctgtactttacactttgtacttgaactctctcacccgcacatgcaacatagccacattgcaacacggccataagtatattcaatttattatttcccttcgcggcgataatgcaaacctcgagccgcagtcgaggtttctcagcggcttattcaatcgccttcagattgcttgggcatgtgtgagctgtggttagggacttacatggcgaggtcgcccaactctattctgttatggtggctcttgccacttgccactacaataaatggccactagaaagataaaatgaacaatactacatgatttcgccacgttacaacaacaaggtttgccctgtatgatggatgcctggcccttttggtgggcgacatgatatgtgacacacagccattctattccaatagaatatgcacagtgcgaggaggggaacaataggttcggctaaggtgattggttgggtgagtgttgtattcacaacggttggctgagggctacggcataacttgctattcggaggcacaccttggtatgcctcattctgtctcaccaattgcctgcccaagagcctagggcacgaggcgtgtgaagttgggcttgttttgccacgaagccagttgataggtcgcctgcaatgccgatcaggcttcacgtccagttgtacgcgggaaggcgcaagccgaaggatacctttggatacgtaacgaaggatacatatgtagctcgagccccgtgtttcaagcaaaactactacagttctagaagtgatcgtccttgaaccgctgatcatattgggtcgatctaagacgcacaaatccctttgggtgcgatgcggtgccagccatgtcactttttccgcttttgactaatgagacagcgccagaaataagatacatctatccacatactaatttagcttatgccagaagtcccaatatttctggccggtacaaagagctacatcgcaagaatcgcagccccaatgcgactgcggtgcctttcgtagctgctgtatgttttgactaaccggctgcaaagcccgctctttaagccgggtttagccaagctgaaagccctgacaggctaagcagcaacctcttttcttcctattgatatgattatactgtgatacaggcttatttttatccccagttttaaacagctttcttaagctaccatcagaggcataagctgcaaagaagctatcataaacctgctgccactacacccattggtctgtataaggctgctaatttagctgcctatagagctgcaatagatagctatttataaggcaggtcttaagaaggaacttctatactaatacctgctaatttcccttataaacccagtattataatccctctgaagcctgaagttaatcactgatattaatactacctatattattattataatccgctgaaactaataggatctgaaggaatttaaccggctttccgctaaattccctcttgatcggatatacccttacttttatagttatcagtctcttataaagctttataacaagctcttagccagtataaataatagttattatcaagactaagatattatccttccaagcgatttagttaatctagagagcccggaacttaattagtaagggaattactagtaaaataagtagggatagctcttataagactatctggtatagctataccttataaccttccctaatactacaggttcttactagctatattatctaccttagcccggataaaaggtttaaaaatactacagttatagcggtatatacctattattctataacctctctctcgtagagtacagtagagatcagtagaggtaaataggttattaataaagatatagaatatcccctttagcagctgatttactagggtaactataatactttagatcgggttaagagctaaggttccgagctacttcctcttataatctcttatagcctgtagaactgtaatactaacagggctataagctgaatctagtatatactataaccagcagaggaaatagcctctttagcctagaacctatatcttaaagcctattagagtcagcttattaggaatagttattatctgcttagatctacctataaagctctgaatatacttattgttgaatttgagagattatagccactataagttagtgggttcagattgctgttagcgatcacaaccactagcctctagcgattgcagccactggccacaatcgctaataaccccctgctaacgctagccaatagcgattgagatcgctatctgatagcgattacgatcactaaccaatagcggctgcagccactgtgggtcagtggctacagcccgctatnnncgctacggcttagcgtgccctaggaaccctcaggggtccgggccaccagcagagctattattaggttatcgggcttatctagcccagataagggacattgaacgtaaggggagaggcagacactaatgtgacagtataaacggcgatagaaccccgatgaaaacggtataatctagagaactgatcgcattgccgatacaatcccgaatatcagtcgtttccagcagtcagtgcttcatcagggaaggattgaacagtactttctggactttgtgaaacattctctaaaagtctgtatcgagagaggtgtcgagcccgtggggatggagattgacaagtctctcattgcgaacgaggacgcgtatcccatcactgtgacattgaggtgagggaaggaggctctggcagatggaaccgatggcgccggagacgagccaggagaagagtgtatagtagaatgcaagtatatgattgggtgcgatggagcccattcatgggtgcgcgaaaagctgggcatcacgatggagggggcacagactgaatctgtttggggggtaatggacatcgtccccgttacagacttccgtgagcaccctatacaaatctctcttgtcgcgaacactggatattgctgactgatctggctcgagcagcggatattagaagtcgttgtacaattcacagcgcgtcagcgggaacgatcatggttatccctagagaacatggcttggttcgattgtacattcaacttgcacatctcacccctacgcgcggagagcggttcgacaggtcaaacggtagcccggaaacgattttcgcggcagcaaaacgaatcttggctccctatgatatttcctataattattgtgagtggtggaccgtgtaccaggtgagccgcaatcacttgggagacgccagtgtttcccttgaaagctgactgtcaagcaggttggccaaagagtagccgacgcatttgcaaaatatgatcgcatcttcttagccggagatgctgtacacactcactcaccaaaagcagggcaaggtatgaatatctccatgcacgactcgtacaacctggtctggaagatcgcgtctgtgatcaaaatgaaagcccgtcctcttannnnnnnnnnnnnnnnnnnnnnnnnnnnnnnnnnnnnnnnnnnnnnnnnnagtgtttcccttgaaagctgactgtcaagcaggttggccaaagagtagccgacgcatttgcaaaatatgatcgcatcttgttagccggagatgctgtacacactcactcaccaaaagcagggcaaggcatgcatgcacgactcgtacaacctggtctggaagatcgcgtctgtgatcaaaatgaaagcccgtcctcttatcttgtccacgtacgccacggaaagacgtgccgtcgcattacaactcatagcatttgaccgtcggttttcgcacatgttctcaggtcgacctgccaaagacatcgcagacgaagcgggcatttctatggaggagttcaagcgaacatttgaaaaagggaacatcttcacatccntcaccagatgcttaaatacggactcgttcctgaaactaacaacctaactaccttgattttgcttttcatttacattactactctgtttacttgccaccccaagacctcggtatcctgctcagaagttatcaagcctcatcataaaatgcctcctccagcccaaggacaatatttcagctataccaatacaagcgcttccagctgccttatcaacgctaatgaggagtggacccaaataagcgatccagctcagcgccgaagactgcagagccgacttgcccagcgtaaatatcgtgagtaaaatgctgatttaactgattttataagccttgagtgaatacaagactaaaaccaaagttaactaggcaatagaataaagagacgtctggaagagcttgagcgtaaggctccggcttctgaagaggtccagaaagaggaacagaatgtccccatgaacaacgccaaagaacctttcgccaactcttcttcttcatccttttcaattcaacaacaatctcgtggtagacaggcatcccaatcacctacatctccaaaaccggtctcgcaagaggaatatactacactacacatatagagcgatacggcgagcccttttctacactgaactctgctggcctgagcttttcataccctccgcctatgcctggtcatgttacgttcctcacctctgatggatatgtgaaggtttatgacaacaagcgccnnnnnnnnnnnnnnnnnnnnnnnnnnnnnnnnnnnnnnnnnnnnnnnnnnccgaagactgcagaaccgacttgcccagcgtaaatatcgtgagtaaaatgctgatttaactgattttataagccttgagcgaatacaagactaaaaccaaagttaactaggcaatagaataaagagacatctggaagagcttgagcgtaaggctccggcttctgaagaggtccagaaagaggaacagaatgtccccatgaacaacaccaaagaacctttcgccaactcttcttcttcatccttttcaattcaacaacaatctcgtggtagacaggcatcccaatcacctacatctccaaaaccggtctcgcaagaggaatatactacacatatagagcgatacggcgagcccttttctacactgaactctgctggcctgagcttgtcataccctccgcctatgcctggtcatgttacgttcctcacctctgatggatatgtgaaggtttatgacaacaagcgcctaaacccaacctcaagcaatattcagtgctctatacctattgcaatcaaccctattcttcagccttctatcacacaatctggcgatattacttatactgatactgacaccacggacttaacctccaacttacaccatgaatttatgccagactctgtcaattcctctcaacttaaggtaagggggaagctaacgaattaactgccttggacatataacttgctaatgtgataggcataggctctaccatatacatctaaacactccacaatatgcccagtggctaagggtcacgacacccccaattttaggttatatccgccatgctctccaaacaataatgcagccttaacaacagaaccagtgattcatagtgtattcaatatctatactcaactgatcagcttaagagcctctttcagataaaagtgggttttataaaagctatatatatcggtcgaaggttttggtggttgtgagttgattttttagatttcctatagtaatgaattttgnnnnnnnnnnnnnnnnnnnnnnnnnnnnnnnnnnnnnnnnnnnnnnnnnnnnnnnnnnnnnnnnnnnnnnnagagaaattagtataattttctggtctctctcacaaaaataagattcttttgcgctatattttgcactatattaggtccctctagtactgaaactcactgagttatagcggagttagcagttgagagctgtaagttatagcgaacttccctgctgtgttatagcggtctcaaggcccaatacaccttgaaggccactgtaatttcaacagctatatttaactttatattcttattattattcttttattagctattcctaattaattaatactaagtctgtatctaagggttattcttatttctatatctaatttaagatttatattatttatcttagttcttattataataagttttttatatttccaggttatagtactattaaggctattactactatatctacttattattataagttattacttaggttatttatagtagtacttttagttattaaaaaataaatatatttttctagtatctgataaaattttgatttttattaatcctgatttagatatttagaagggtactactactctatatagctagtatactaattaattagtaggtttatatcttatagctatagtagctctaatataatattataacctcctagtagtactaagttatatataatattaaatttctttccttagactttaattataaaataattagtctctaagttaataatcctattattatacttaaattttaagccttctatattagctattatatagatttccttcttctttctctatagtaagtagaattagttaattactactagtaagatataattttcctatactctatagttaataaatactataagctagttccccttaatctctatttctataagaatatatatagagcttcctgcttctactactcctagggtcctctaatctattattaatattattctgtactatagccctattatagatagtttaggttattttttacctagttaactctttctttaagtatactatacttattattatattttaatacctatttcagaagttcttctagtatcttaggtatatctatatatcctaggatatatctttaaaacttccttagctatctgctaagtttgttttattctttataaggtatagcttcttcttaagagtaatctgcagtctattcttatttatctatagaagtaatttctagttctttattagaatccttatcttctattaataatactattatagcttattcttagtattagtattatatttcttcctaagcttagtattatttaagtatttatttagtaaggttcttattattatctctactccttactagattaagtactatttattttatatatagataatttaggtatttctaattataatactgcttaatatattctctacagttataaacagcttagtcctcttaggttttctatttatactatagtttgatttttttatccttatagatcttatactattctttctagtatatttcagctagtatattattagctttatattcttcagggtacttttctaaatcttatttaaagataaagtattagttaatattaggtagtctatttataaattataatatttccttactagtatatctagatagtattcctttatttagctatagaaaggtattatttctaaccttctgttgctaataaatagtataaaagatattataatatattaattataattccttatagtatttagttcttaaggtcttcttctaccctccaggtagctggttaaggctgtctaggtattagatagtatctatagttctttatctatagactataagcacttctaatatagctggatcttactctttgattttctactgatagtaggtatagacttccttatattcttcttatattatatcctttatatatatatattatttttcttcttctagtatttattcgataaacctattattatatctgaatactgttttatagattataagcggactatatcccggttcttagtttactctatattttattttaagatcttaaaatatttccctgatctattattagttctttattactatactataatcctaatctttagaatcttttaatatcttataaaggggtagtatatatattatagaaaattcaggaatcctaatattatctagggttccttcctgagtaggttttctaactattctaagagttttaatctcagttcttccagttactcctaactgcttcttaccttccctagcaggtttctacttcttctgcttccttagttctgggtattaaggtaatatatatctaaccttattatagttatagtatttatacttttctatagctcctagctctataggacctgtatatatcccagatactatagatagtaacagagcttattatactccttggttagatttatagcttatcttaatatagttctaactactttattttttccctttttattatttttatttaaaaaggcagttattaatatatattatagtagctatatattttaatagctcttttagcttatctagtttaaaaagttaatctttaactttatcttttagtctattataaaatatagttttaaggagtatattatcctaatccagtcaggatataatctccctgaatcttactatataacctaaggcagcccctttctatttaagatccttaagttcctttatagcttgctatttatagtttaccttactgaatataatagtaaaagtagtaataaagttattatagctagtaaggatattaatagtctcctagctttataattcaggtttagccttattattatactagttatagaggaatatctagaactagtatcctatagttctaataagttatattcctataaacctgatcttatccttatcttccttaagcttagttaggaagaatttaaagtatacttaaagctagattctgaatctattaagttcttaaatatctccagcaaaaggtcctagtagtattagtctaataatcttaccctagtccttctataacttattcttcttaaggctcttaacttaaagtataagttatttaataatctactgagcagtaggtagccttatagtactattctgctaagcaggggttcctagggtagttatagtatcttctttattattatatagtaatttaagataaggtaatcagctaaataagagttattaatatataacagttagataacttatactggataagggtctagagtaggttagggttaaactaattagagtattattctaagtagtataatcaggttattataagctgtataatataagttactattaatatataagtattataaagctagtaataatagatatatagataattataatatattaataactgtctgaaagagtattctatctaagaaaataaatatatatatatactaatagattattaatacttagtaataatctgtatttatagattataaggattattataagatctgaataatcctattctgattagtagtaaaaagcggggttctatatataatctgtatataggagtgaaatttataataatataacctcctataaaaatataaaagcttcctcctaatatagataagaatagggagaataggcttagtttcttttctctttataaggggagttcctaaggtaaatatacctatatactaatataaagaagggaagaagaatatatattatattatcctatagtactctagatttaaaacctaataagctgaactaagtactagaaggctaatatagatctaatataaccttaatagactaaaaataaaatatataagaaattataaaataggttttaaatcttaggatattagaataatataaacttactaagaagctggatatactaagtagaatatatagaaaccccagataggatctaatctatatataaatagaaaatatattagataatacctagacctagttaatataaataataatagaactattatatatagttaaatagatataaagagaataaaaacagtagaaaaaaacagagtattagtattaagagtataaactaaagactctaaactatagaactaattagagcctagagtaaacctagggtagaaactaatctaaggctccttagatatattagtattatagctagtagtagccctactagggatatactctttaaacctactataactactatctttaaccttactcttactaaatatactactaggaggaggtatctctataagagtattaagaataatctagactgattctgatatagctatagctataagggctagaagtttatataaaagctggttctaattaaggatatttcagttaagtatatctaactaagtactaagggtagttatctattagtagttctttttacccttagtctctagggtagtaataatagtcttattattatatagggcctagaataaaaccagagcaggactagtatagctactaagggtagtagtactagtataatcctaagtactactagagataagaatataaatagacttattaggctaataagctataaccttcgaaataagtatattctactgagcttactataatctggattagaatagaaactaatatagaaaagtactagataaagatataagatatatattaaattccttattactagaagtaatattaatagtatagatctataagtaagtaatatacttagtagagagataattaataggatattatataggttaggatcagaagagactaggactagatatagacttatctttaaataggaagacttaaggctataatatttatagtagaacttagactagagatttactataggattagtatagaactaatctagaaatagatagaaaacttattagattagagaatatagtaggtagtatatctattagtagctatactactaatatactactagtaactagtcctaggatagtaagaactaaaaagagctagaggttaggctggagataaggtagaggaggagggaatagactagatctatatagtagtagagagtagagagtaagatagaatagaagaagtatagaaataatatagagtaggatctactctggatcttatttatattagagttaatatagagaaagaggggaatttatctaattatctaattatataaagaagaaagagaagaaagaaggaaaagtagttagggggaaggaagatatttatagatataggagagggtataagtaatctgagtaatctaagaacctataaggaaaatatactagatactaaaaagttatataagtaatagtaaatatataaggaatctatattataactaatctgaactagtatagtaactatatctttctatcctataactaaaaaagttaaatagagaagaatataaagttaagaaactgaactggagctatactaaatatatatagagaatagatcggataaatagaaaactaaagataataaagaaattctatctagataactcctaaagagaaaattaaaattaaaagaaataaaactaactaattagataactagaaaaataccctctaaattatttatttaaggctagttataagaagttaatcttaagatagagctaaattatatctaatataaatataagttaaaaactactctatctatactaactagcagataagagctaaaatagaaatatagtggataaataaaggaagataggaaactaggagctatattagtatctagataaagctataaaggaaataagcagaataaggtttttattctatataaaaggtttttccttattagagattagatagagggactagagactagctagacctagtacctagagtaaataataataatataaataatatatctttatacttattatatagtataaataactatatataaatatatattagattaatattaaatctatattattcctaataaaaaccttctatagtagtaaatatatactatacttatagagataaattaaytaataacyttatataactaacttttcttatttctaaataagtataattttagattaaactaaaataaactctaatatactaatactaaacctgatctaataaaactaatatcctaatctaaatataactaaaaataatataaagtttaaataattaatttttaagaactatttctactctaattaacttaatatagtatataatatattaaaactataaattatatattagattatagtaggcttatataaatagatagctattcttaagatatagcttttcttctagttagtttctattctctataagtatctatagtagtactagataggctatataataaagtaataaactaagtagatatagctactagatttataatattaaaaacagctttattactataagtaggctcttaattaatcagagagatatataataaatatagttagtaaatagctatattaaattacctcagataatagttattattactttaagaatcttattagaaatattaattaggttctaagagattagaatatttatattaaatattatagctataaatacttactaggtatctagtaattaattaattaagtaattagtactttaagttagaaaggaaagatagttattactattagataataagcttcttctcttaggggctatagctatagctagattatttatatatatctagctatataaatagctcctattattagagtttttaaggtattaatatctatacctaggctgaaagtataatatttaactttatcttatagtattaaaagtttagatataaactactaattatattcttaaaaaatatatatcagattatatattacctgatcttaggatatatctttatttatagtaaaactaatagaaaatatctttatactaatatattctaactctttctttactatatctaactcctatttagcttattaataataagctctaatataataaatttgctatatagataaaccctaaatattataatataattaactatataatatatagtttatatagtaagaaaaatctaataagaaagtctagtacttatacttactatagttcttataataagaatatactaatataatagaagaattattcagaatagtaaaaagaagagtatttctataaattatagataactcaggctttagtatctttaattttaaaatataactagaagatataatattagtattagaaataggaagaaggagagaaattagataatatactaaccaggctataaaatataatcttaggaataaaactaataaagagggagtattatattataaaactactctccctatattactaaatccgccttagttattactaagggttatataagataagctgatatacttagtcttctatatattaaatatattaatctagagctaatagtaatatattatatatctaatatattactcttctatatatatatatttattttattagatagaatactctttctatagttattaatatactataattatctatatatttattattactagctttataatacttatatattaatagtaacttatattatatagcttataataatctgattatactacttagaataataccctgattagtttaatcctaatctaccctagacccctgttcagtataagttatctaactgttatattggaaagctttagttaatttctttactaatactactatattatttactttactcagagtatcctaatatataatatactctatatcctctataaaagaatacctttactaggttaatattagtatactaactatattacttaagggataaatattcttactaaaaatactaatttatatatttacctctagtaatagtactaaattctttaattaattaatagtttttagcttattaatagaacttctatagatttcttactaaacctctaatctatttattcttttaatagctatattattaaaagtatctatttatttattaatagaaactatcttcttattaataataataattctattaataacttaattaattctagtatataatatcttaatagacttctatagctagttaatttctatattataattagtaattttctctattactataattaggttaatattttctttagtaaactatagctaaatcctattataaaattctatttttctataaactattaaatctatttaatctatagatataagtattattataatctatatattaaaagaatagagagctaaaaaatataaaataagaatattaacttttagtagtataagaattttaatatatttcttaataattcctataatagaattataaaatctactaatctctatcttaatagctcttttaatagtagctcttatataataaataaagagtatcttattaatataatctgatttaaactttctaatctccttagagatttctttaaaatactaaactactatattatattcttcttaaagtttattaaaacccttattattattattattcagcttagctcttactatattataattaaatataatagtttagatatagatattagggcctaggataaagttaaatctaatattagtaatatttattttaatactctagatctacttctagtaactattaactttagtaaagtttattatataatactctaacttagtaaacttcttttttattatctaaattatattctattctaacttattattattcttatctttactaagattagaattagtattttatttattactaattttaataactattttatataagtctatttaaatagtatttttattaagctcttctctattaagatcttctttattaaaattacctttattaagattatctttattattctttatattaatatcctctatatcttctttactaatagttttataaactttcttattctctttattagagaatttaataaccccttagtaataataaagagatctagtaactcccttcttagtaaaagttattataaatatattaactttactaatagtacttaaagctatataataaatattagatttagctatcttcttatcctagttattatctatagttttagctctaatctagatatagataataggagtattatctattttaattataattaaattctatttagagatagtaaaaatatttaaactatctatttccctagtttagctaatttaacttttcttacttttaaatctatattaagaaagtataataagattatatagtattcttagagtagtattagtataaatactatctctagtaattatattaagatattcctatatattataattttctattatatcttatttaataatctctaaatctactactatttataggcttttaatattctttttaatattattaaacttaataataactttataactcttagtataatttaagagttctaaagtataataaactattaactaatataatatattatttattagttttaataagtattctataaaagttagtaaaaagctactaagttcctagtaaatataattagaataagctcttctagtaatagtttttagtataagagaattagctttctctaactttatttttataagaataaaattattaagagaaaagctataattagcttctatttctattataacttaataaagttagaatatataggaaagaaaaataatatagagcttttaggaagtatatatattattattataagttatatttactctagtaatataagcttctattttttataaatatagtttactactaactattagtagcctctatatatatactattctgagtaatttatattatactactatttactctagctttttatttatttaaatatataaaattaataactagaattaatagtttttagactaattctatattcttaaaataaattctaagatctaataattaaatccctcttctttatatataaattatactagtttctttattctttttaatatataaaatattctatttaatttatataatctctagcttttctataactaactatatatttaactttatatatttttttttctattagttttactataaataaaggtatatcctaagatcaggtaatatataatctgatatatattttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctaatagtaataactatcttttctttctaacttaaagtactaattatttaattaattaattactagatatctagtaagtatttatagttataatatctaatataaatattctaatctcttaaggtctaattaatatttctaataaaacccttaaagtaataataactattatctaaggtaatctaatatagctatttactaactatatttattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctagaagaaaagctatatcttaagaatagctatctacttatataggcctactataatctgatatataatttatagttttaatatattatatactatattaagttaatcagagcagagatagcttttaaaaattaattatttaagctttatattatttttagttatattcagatcagggtattagtcttattagatcaggtttagtattagtatattagagtttattttagtttaatctaaaattatacttatttagaaataagaaaagttagttatataaagttattaattaatttatctctataagtatagtatatatttactactatagaaggtttttattaggaataatatagatttaatattaatctgatatctatttatatatagttatttatactatataatataactttatatatattattctcttttattttcctaagcttaactagattaggcttagaaggagttctactatataagttttttccttatattagtttctatagctatactatagagactactagatagatactataataagtagggaagtttaatttaactatctaaaaataaattacttcctctacttcctatagatctaaccttatctaagattattttttctttagctttctagataaatagtatttattataaagctaaagatatactatattactcttatagaaattagtaggagttctctacctattatatctctcttttactaatataactactatatttaataggagtatagcttccttttagttgtaagagcctcgagccttgaccaggcttatcctcggagctacgggtcaaggccggctaaaggcatcccttcggccatataaagtatttccaacccacatatagcctacttggaagcttcaagctttagtactcaattgaattgcaaggcagccttattttcctctacctgactattataccctatagtaagactataacaattctaaagcttctacccctagttacctagaggaagatagctcccgcctttgcaacccgaagcgcctcaacatgtgcccctgaaaatctcgcacccgaagacctccttgaggagacaattaaggagcaagagcgaggaagtcgtaataactcaaacgaaaggaataagaccccaaacaccgatcgagatacacccgatacctctactgaacctggagctaagagggatacacctgccgagaccctcagcataatagaagcccgtatcgcggacctcatcgaacaagagagaaccattcaacgtatcaaggaagcccaggctcgagagagggagctacagcaatcccttgcgaagctccgaggggaaatcgcgaacacaccctcgaagcccaggcgaaacttatccggcagtgataacagccgagacctaccgctccctgaagttaaacccctgaggtcgacacctatactcagacgaagggatgagtggctgagcgatctcgaactcgcctacaaaggggccccgaagaagttcaaagcggaaaagaaaagggttctctttgcagtccaatgcttggaccccgaaccccgagcgatatggcacgcacacctacgcgatatacccgcgaaagatcgagaggcaaataagacggatctaggctacttctaacgttggaccctcaccctaatcaaggatgcagccaaccgcgaggctataatagcggatgaattcgaggaggcaaagcagtgagaaaatcagtctcctcaggagttctacatctacctcagctccttggaacagcattttgaatgtgcctctgaggtacgcagagcctcaatcttcttttctaagctagataaaggccttaaggaccggatcaagggttcaggaaagaatatccccttaacccgagacgaggttgtaactctcgcgactcgcttctgggaccttactgcaaccaaacgcaagtataccccctcgggtgaatcacgacctaataagaccaaccaaccgccgagctacagcagatcttgaggagcaaggccagggggcagaagagaaggaggttggttatgcaaccagagtagcccaaacccgtatccgccgaaaggagagggaaaccctctcggaagtgatagcaaaccccttcgctgctatcaatacaactcaacagctcaccttctccctgcctgtcctgataaagcctcctataagccgggaaatactaaccggtcgagatagaggacctagtcccggctgaacagtaaagcattagggttatataacagctcaatattcctattcagatataaggataaaaggctatcgagacccgcgctgattgggatacaggagccgaggtagatattgtaagctatatctttgcaaggaagtatctcgagcaagtcagtatgcctgtacccctcgtacgggctgtaggggaaataacagtcccgacttacggggcttggaaggctataattacagctactgactcacgaggggctatacgaacattcatacgaatacttattacactcgacagggacccgagaccagagggaagccctatccttctatcaataactataatagaggataaagatatcttcttctatccgaaagggaggcagtggtagtacaatataccgctaaagcaggttaaaataatacgccctgctcgctttctacggtagtactaacgagtagcctgagtattcttaattgaggtaattgaggactttactcctttcccggataagtatccctcctccataaagggaaaagacaaggtaccgaccgagtttcgactgtataccgatatattcaatacagccaatgcggtaatactcctacactataaggctacggattataatatcgagctctaagaagggaaggagcctccgtataggcctatctacccgttatcccctgccgagctagcccagctgtaagaataccttgataagaacctgaagaataggcggatttatccctccaagagtcctgccggggccccaattctctttgtaccgaagcaagacagaacacttcgattatacgttgattaccgggggttaaaccacctaacggttaagaaccggtacctattatcccttatgtccgagattatggactgaatcaacagctgcaagttcctcaccaagattgatgtaaaagacgcctactatcgaatctgaatccgtaagggagatgaatggaaaaccgccttccgtacgagatacagctactttgaatatctcgtaatgcctttcggattaactaatacacccgcaaccttccaatattatatccactaagccctgcaggggctccttgatactgtttgtattacctatctgaacaatatcctgatattttctaaagatcaggatacatatacagcccatattaaagaagtcctggagcggatatataaggctgaactgtacgccaagccctctaagtgtatattttatcagcagtctgtggaattccttaggtttatcctattaacagaaggggttttaatagatccttgttaagtacagactatataggaatagaaggaacctatattataccataaaatccaggtcttccttgggttctataacttctatcgaagatttatctatagatactccagggttatagtacccctgacggagttacttaagggaaataaggatagaaagaagcctgggaatctggtactccctgttaaggtaaagcaggtgttttgcacccttatcgaagctttctaaagcatacccctcctttattatttcgattaaacccggccaatcagggtagaaaccgatgcttctaacttcgctatagcagggatattatcccagcctgacgaggaagggtgttagtacccgatagccttctggtctaggaagttcaataggactgaggtaggatatggtactccagataaggagatattcacaatcgttgaatcgtttaaatactggcgatactacctcgaagggcctgagaaacccgttaaggtcttgtcagaccactataacctgcaagggtttataaagcagctgcggctgaacgggaggcaagcccgttagtatatattactagcgctgtataactttgttattaagcaccggccagataacagaaaccctgccgatagacctttgagaaggcctgactatgcaggagaaactccaagcaaccttaacctcttgcctacactcgctaggaagatggctgctgtggaatccctccgagtgaccgcagcaggcttatatatagccacggaggcccaagtgggatccattcgctgcagggccctggctaagggagcccaggaggaaagccttatgcaagacaaaggagatacggccgagacccgactgatccctttggtgcaggcaagttcggagacgagtctccctagagaacaatatattactagggcacaggcccgtcaggctgcgaaggataaagacatctatacgccggtgatctcgatatccctagtggggataatccgagaagcccagaaggctgataagatgtcagaagcttttaagaggggcgataagtatacgaaaagtagttaactcccagacggttatataataaaccctgagggactactgtattttaaagaccgcctagtagtaccggaagaggcagccctgcggcatgagattataaggatttattataataaccctcttgcagggtattttagagggaactaaacccgagagcttataagtagaaagttcttctggccaggtatagatatataaataagagagtatattcgagagtacccagtgtactaggggatagttataaagaggtatcggctatatagcgccctcgaacctctgctaataccctcttgtccctggagccaaatcagtatagactttattataggattacctgttaatatacgaaggtataataaagtggatataatatttattatagtcgatagatatacgaaatactcccttttctttatagtccctagtatgattactgctgtagaattagcagagctattctatactgaagtggaactgtaatacgggccgccggagggtattataagtgatagaggattactcttcacgagcaacttctgggctgaggtccaatatctttcccgtattaagctgcggctttcgacggcgttttacccacagatagataggcaaacggagaggataaactaaatgttggaatactacctccgctgctttattaataagaatcaagcaaattaggccaatctgctcaagactgtacaattcgcatacaataacgcgataaatatattaatatatatatcccctaacaaggcgttatttagttatgagcctaactttcaggttcgtaataaggacgctactgtcggagggagagtgccggaagcagaggtatacatcaggaagcttgaggaagtttgtagctaactggctgagtagtagcgaaaggcaaatgaaacccagttgctatactataataaaaagcaccaactgataacgtttgccaggaagcaactggtgatattatctataaagaacctccgccttaagggcgaaaaacgcaagttagcccctagaagggtagggcccttcaaagtgcttgagaagatcggcaagcaggcgtatcgtttggccttacctgagaagtatagctatatctataacgtattccatatgagcctgcttaaaccgtagtacctacaaaaggaagagcaaaacagtacagaaataatactgttccccgaccttgaggacgaggacaaccagtaggaacttaaggaagtccgggataagcagacccagtaaggcgaggcttattatctcgtcaagtggaagggctggccctcggaatataaccagtgggttactgaagaagatatagctaatacaactgcagctattcgtaagtacgagaaggcataagcaaagaagagaaagcagctacaaagcgcagagaaggggtgattccattgaacttttcaaacgggctgaaacccttataagagctatacggttattatatataactaaaaacaaaccaaaacacctccaggccaaaggctgcgatctattttccttgcctttagggagcagagctcaacccgcggtcggtataacccgccagataaggtcctgaaccctaggactaagctgagatcttcacgatcagtatatcagctacccaagcttgccgaatttcattattgatttcgagcccagtgacctccccgtcactgtcctcgagcctatcaaaccactcggaaaagcgcgagataagggaccgaactgcgatcctccagggcatgaaacccgtatcaccacagcaaatgcgtaagagttaggtatcctcctaaagagccctctgggaagcgtagcggtaatacgcagcacggttattcttctagattcccaagcaattagtatatgcttacagggcgaaagggaatcgatactcacaccgtcaaaagaggggcagcgaccatacctctgcaggaggtaggtgcggcgtaccaacatccaagtggtgtaggcagcaagatcctcctaaaataccagagagaccaatcatcagtataactattgggaaactgggggagaacgatatgtatacacatagtcttctgagacccggaaatattgtgtttttagcgatgggttaactctaagtagctgaaggctactataaactcgtggacgatacctacgagttgggtccgctgagcacgagtaaaataaaagggctccttatcgccctcctctataggggcatccttatacccaacggcgggctttaggtgaagaaactcattaacgtactcgagtacgtctacaacatcgcgattgttaccctcgataccagccgccgcgctaccccaaggattagcaaccgaaacccaagttaggaatctaagaaaccagggctgtatggccgctaggggaatactcacggaatgtaagtctgctgtatctcctggcagtgggtgcagcggccggactcagtatcgaggaaagcacacctaattacggtgcgagaaacgggataaaacttggctggccccttgagggccttcttatcggataagatagcgcttcggaggtattttatatactataactcctcctctaggaggggacgagaacgacgaacacgcttctgccggcgtgttatagctgttttggtaacagcgccactctttatggattttggaggtataccgcagcgaaaggatactgaaatacaagggtaacgagcgtttatgaaaataaaaaaacccaactggaaatggaaacatataataattccgtgacgagcgaagagtagaagaaacaggcataaagagaggaggaagagagctgcaaggaagagggaaacccgactcaagtagggctgagggaaaagtgaacaatactagcacgcgtgcctacgggtttatttacatctacgaattgtacatatgcgctattactgccgctgcccgtgtgggcggtatgaggtatcgcgaggctgttgggtcaccagctattgaaggggggataattgtaagagcctcgagccttgaccaggcttatcctcggagctacgggtcaaggccggctaaaggcatcccttcggccatataaagcatttccaacccatatatagcctacttggaagcttcaagctttagtactcaattaaattgcaaggcagccttattttcctctacctgactattataccctatagtgagactataatattagtatactatttaaagaacttctaaaactatactagttttcttattaggctctaatactaactttttaactatatttagatctaagaatagttaaaattctattataagcttatttagagagtaactaagtatattattttttatattattaaagttaaattataatactaataaaagcctaatctataaaattaatagattaatagatatataatactaaattataatcttaactatctagtttttccttttagatatactatctatctaagagtagtaagtagttaatattagtagctttatttatagaatttagaagatttccctttagattttcctagtaaactttagatctctattacttaagatctactttagtatattctaattagctaaaaatagcttaattagaataatttctatctaatctatagctatatatcttatattatctagtattagaattatcttcttactaaatatatatattataatatataaagtattaaaagtattaaatcctactttagtctatctagattctatagagaaaatttttagtagattagtaataaaatctagtataatagtataaaatagctatagatatatctaaattagccttaacttctttattagagattccctactaattctattttcttaataaattagatagaaattaatatatttatatactatttttataaaactataaatttaatatctattaagttctactattattctttttatattaaaataatactttctattatatatactttctagtaagttaagaatatagtcttatagaatataaaactattactagctattccctactaagtaaaataataagctatttttctctaaactaaactactttagagagaaatttagtataaatcttagtctaatagctactactattttttaatcttttctaactaattttatatatctaattttattcagatactctataatccttatatattttaaatctgatttatatttctataaaatccttctagtaaatactgaatttattactacttctatacttattataatataatttagttctatcttagttctagttactttctctttctaaaatagaaaaatatcttctataatattatactatagcttattatagttacttttagctactatatactatctaggcttttaaactaatagttttaatagagtatctagaactatattaagtttatcttctatatagaaaattttaaatctaaattataatatctaatttataatacttattagttttaagttagttttatttaaatctattatttagagtaaaatatatattataattccttttattactatatagtctataattatattaactagataatagctagattaaactatttatcttaattttcagattatctaaactattactataatttctacttctattaatctataagtctttttagtagtagaagttattcttaataggaatattataggttttaatcttatagatataatttccttccttagaattccttctctattctatttatagtttaattagaatatatatatactaaatccctctttatatatatctatctttataaaaagatatttttctagatctatatattataaaaagaattacttactaaatactttctataatatttaaaataatttaatttctaaatttattagtttaaatattagtttctttatatatactttatatactgctttattaattccttctagtataatattatcttcttttaccttctttattagactaattttatatatctatagtagctttattattatattatactaagacatactatcttagagttattctattatcttaagatagatttctagtactaataggttattagagaattctagcttagtaaatatagttaatctcttattagttttatagatttcttccctatttactatatatctaagtaactttatacttagatagataataaataatttatttactaaaatataaatatagtttttatttagtatttaaaggatttactaaatataattaaaatacttttctactaagtttaaaaagattattatattattaatataaactcttataaaatatctatatttatatagtatttagtttataaaatactaattaaaacttagtaagttataaaaatctattagaataatattagaaacctctaattctcttttagagataattattattctatttctatactctatataaactagaagctagaagaaaaattttattatattaaatatagtaaagaacttctttccttttatatctaatagaatatctacttaatttagtaaagggtatatatttagtattatattactatttaatagctagaggttaattataactcttctcttatattttcctttaactatatactaaactataaatactaagtagataattagagctagtagatctattagctctattttattattagctattaacttattatagattttattaagaaaatagtaatctttttatctaagagagtataattagactattcttttctaattctactaactattaattaattctactcttatttttatctcttttagtattagaattacttctctatccctataaatattatatttatctattatttagataaaatagtctactagtaccttattaaggtttactatatagaccctgaatttattcttccttactaaaatctctactaactttaagattctataattagataaactattattaattactagtaactagaaatcagttagatttatattactatctggataatttctctactacttagtatcttttatagctattgaaattacagtggcctttaaggtgtattaggccttgagaccgctataatacagcagggaagttcactataacttatagttcttaactgctaactctgttataactcagtgagttttagtactagagggatctaatatagtgcaaaatatagtacaaaagaatcttatttttataagagagatcagaaaattctatctaatttcttttataagtctaccgactaaaaactactctaaaacctgctaaagctgctttctgggctacttttgattttctgtaaaatttattactataggaaatctaaaaaattaacttataactactaaaaccttcgaccgatatatatagcttttataagacctacttttatctgaaaggagctcttaagctgattagttaagtatagatattagatatcttatctttaaagctgaaggaattatctaagatctaagacctagtctagggtaggctggttatagggtagcctgggtataggttagatcgtctgagaatatcctaggacttttcccggattttctagacccttatttgggctagataagcccgataacctaataatagctctgctggtagcccggacccctgagggttcctagggcccgctaagccgtagcggtcatagcgggctgtagctactgacccacagtggctgcagccgctattggttagtgatcgtaatcgctatcggatagcgatctcaatcgctattggctagcgttagcagggggttgttagcgattgtagccagtggctgtaatcgctagaggctagtggttgcaaccgctataagctagtggttgcgatcgctggcagctagtggtcaggatcgctaacagcgatctgaccccactaacttatagtggctataattctcaaatttaacaggtattatactaaatagttttcttatagaaatatttctatatatagttagatattatttatagaagatataagaggaatataggagaaagttaaataacttactaattaaactataaagtatagttttagaatataactaatagagagagagtattatattataaattttacttttatatatagattatatataaaactctacttttactactaattagaatagaattatttagatcttataataattcttataatctataaatatagattattactaagtattaataatctattagtatatatatatatttattttacttagataaaaatactctcttagtagttattaatataattatctatatacctattattactagctctataatacttatatattaatagtaatttatattatacagcctataataacctgattatactacttagaataatactctaattagtttaaccctgatctaccctagaccccgtccagtgtaagtcaatcaaccgttataaaacatctcataggaccatacccatcccccaaatatataaaccaatgtaactgtgaaacctcctgccccatttataccctttataggctttacaaatcgaaccacttgtagtccaggtcagagttaactggaacggtatgaccaacattctgagctaggtatccgacaagcttagaaccattgccatagacacgttgagagtaaccgctctgaggagtgttggggtttgtggccgtgagtgacactccgtgaaggttggaccactgcgcgagctgctggtccaggttggcaggacggacaagggtatcagctgtgccgtggagagtagacagcttggggtatgcaccactgtatccagggtagatgtccctggccctctgggcccattgagccgggctaaggttgatctggccgttggcgcaggtcgggtcagcgctgatggggctgctgccgggagatcccttgaggcaaccggccgcgacgccagagtagcaagtggcggcggtgaacaagtcggggtacgcagcgatcatgacgttggtcatcatgcagccggaagaactaccggtgacaaagaccttcttggtatctacattccaggtctcgatggcgtacttgaccatgttggccaagccggtgctgtctccgttgccatcgcgcttaagggatgccgcagaggcaacatcccagcagttgaagtcgcgactggaggacgggaacacagaaatgtattttcgctgtgcgccctggttggcatagccggtcatctgagcatattgctggccactgccaccacaggggtgaagtgccagaatgagagccggcttttgcaggttggacggaacattgacatccattttcaaccctgtggggttgttgccaaagttggggatgttttgtaactgggccatggcagttgccgcaagggcaaacatgccggcgatacttccaaccgtcaaaaagccgtgcatacttgtggacaaccagatgagagcctcactgtctctttggatttataaaaaaaaaacgtggtatgtaatctgtcagtagtgctgggtgggtatccaagcgagttccaatgactgttgaagagtagaagggggatttctccagaaccgagagatgctacgttttatatatacattgttcataacgcgtatatcagcgtcgcaatataacacgacctgattcttcagctagagcttgccgtcagccgagaaactttttgagccaggctctagttccattgtgctgcttgcatactcggcttctcccttccgtatccctaatatagcattaacggagacgatgtgccgatccgcgctgcttcacccagcaaatgattctcactttgatccataagattcagcctgttgacggctagttaatttaattcttgatttagtcttacttgggttttatccaactttagccagaataaatgaacaggttatatatagatagaatgagttaacttttggcccctgagtggatatatagaacttggttatatagcatccaatgcataatgtatcctatgttataccactgagacgccagtttaccctttcgtccgctccaaccatgccaggacaataggttccacagaatttctcttcgtatatactccgtgtatctgtagaatcacgcatttctcttacgacaggtcaatttagttgtgcttcgttttgtatagagaacaaggtgggatcttagatagaaatgacagctttgggcgactgagatttctccactcttatctcaactcctcatatacccgcagtatgagggcatttcttagcgattacatattgcacaagtaaaaactcaaccctttatatcactgtgatacagcggttattgaagataagcccgctgaaagcccgaacgccccaattgtagggtatcgacatgggcgtcgcctgaaccagggccacacatccattccagatgccagaggttttctcggtggtaccaacggccttgagggatctaccactgccactttagacgtacccgtaaatcttctcgggcgagacattgtaatgctttgatgcaacttggcgagagacttttgcagcagccgcatcagcacggtagctaatagaccccgaggcctggatagtataaccactactttgaacaccaaagatgatagtgttgtcgtcggcggtcgaggtctgggatggatacatgagctgacagaagcgacctctccattaggacttaggcgggagatagatcacaaagtgtaaatcagtatcgttgaaatgcccgacaatccttttgtgtagaataggattcgtcgcatctgtctcgctttcgaaggtagggtaggggttgtctgtatcaacgcgatctgctgtcacaaatacagctacactctcgtcatccgtcgtacagctaacacctgcttatgagccaatatgaggcgcagcggacgccgctaagcctatgcaaagccagccaagtctagtgagaacaaattagattgctcttaatatatcagggccagttcctacaaaggaatacaacgcattgcaaaaagaaagagtagaaggcgttaggacagagtgtgccttgtattagtcaaagtacaagaaaataaattactatatagaaccatgtttgactcctgtgctggcaagacatacatcattttatatctggtgccgcttctatgaagatatttctatattcgttaaagaggatccgagactaccgcaatacagcattacccattatgctaagagtaacaaccagtcacttggattccgcttccagcaatgtcttaatcgaagagtctggctcatgatcccgtcgaccgggatcattgtcatgcatcagcatattgatcctcgacggtacccacaccaatccttagagctcggttacccttttgtttcaacattttcgggttcaaagttggacatgaatgcgaaaaaaaaaattgattagacgactcaaccgctacactagatggtggtgcttcgcccaccacttcaagaacttttcacaccaaccagacaatttacgtatcgagacatcagaacgagtggacgatctcgctcttcgcttagcgccaacccgaatgtagcaactcggtgttctggcgtatgtcgatgaagagaaccatggatgatttgagacgggactaacaacacaatccgacgcggccggccgtgttgtatcgaatctggctatgactcactgcccctgcaggcactgactcgacttaacagtcctcttctcggcatatttatagaggcaccaagaagacttcactacgtcttgtggcaataacagcccatgtctatgtgcttctctgctacttctttcttctttcgttcacctatcgctgctcacaactgtacatcagctactaacagattactatggcggacaatacccccgctggttacgccccatttgacttgttcccttacaatccgtcgcagccagcggcgttcgctttcatggctctcttcggaatcgtcgcggtttcacatcttgcggcaatggttccctatcgatgtttcttccccatgccacttgtcattggttgtggcagtaagtttgcagcgttatttgtgctgatcctgatatgctgacaagaatttcatagtggaagcggctggttactatttccggtctcaatcacatagcgacgtgagacgaacgcttccctttaatatccagaatctgcttgttttggctgctcctccatttcttgctgctagtatcttcatgccgccgcgccggatagcacgagcattagacagcgaagacctcgtagccacgcgcaagctcgtttcgaaagttttcgtcgttgtcggtgtagcctgttttgtgactcgggtggtgggcacaatcatgtctggtagcgagaatcccgatgaggcgcaaagcaggaagaccatcatcgttgaagggcttatcgttcaagcaacctcgttcagtatcgtcgctatctgggcaggcagttcacagtggcggctccgatctgtcgtctgtgaccgatcgaggctcggacaattacagtggaggcgaatcatcaatgccctgtgtgccattagtctgctattcatcctgtgcagtatcacgtgcataatagaatatcaacaaggctcagatagtaagatgttgtccaaggaggtatctctgtatattcttgacggtaccattatgcttgtcatctctattctattcttggtctttcagcccgacagcttgaaagccaaagctcaaaacctgtcagcgaagggtgacggatacatggatgaagagatttagcggcggcaacacactcctcaataattaccacgggaggccaggtaggcaaagtagctgtagccccgcaacgaagcgagggcatccaaatacatggtctagatggacgtaaaatcatagtacgggtggagtagacatggagaagaacagagaattaagtgcaatacatacaataccagcgagagattttgataacactagacagacatatatatagtattacatagacacgaagatagagtcttcatggtattgggtgcaggttccaacggagcatatctcgtgacaggtaggagtgtagctaagatataacaagatgaaagtgtaactatatgtaagtgcgcgataatcctacccggactggtgcttgagtatacagactggaaaagctcacggcagccgatctgtatttccgaggagcagaagtaatttataggatgatatgatgaggaatcgattaaggaagctcttatagtaatgcctgcaacgacaatcactggcacaactatttgcttaagtacgactgatctctaatgtatcaatgttaatacgaacaaacgcactgattgggtccctagccagagctgctatgctatagcttggaagcaaggctagctacaaatcatatgattggctgttgttagtagcctgggcaggatagggaattctataacagagtactttggcagcccagagaagacaccagatgcgataacacttactcagcttgttataccgtgttttaactatatctatatctacttgaacttgagacgtatactaattaccacctaggagaccacgatctgtctcatctcactatcagttctatttaaagagatatctaagaactatctcgctccgggctaacaatgtctccattgtcatagaacaagcgacgcattgcctgattgtgaatgaagaacgatggtccaaaggtatggagtttgtgaaaacacctatatatagcacgtagaaagcgtgatgatattgattttatgatgtgtgaaatttataagatttgaaatataaaatttgatcgaacgtatttttaaggcgtaaatatttttaattgattgtgcattgttttgccacatgcacacacttcaacattctcaaagaagttcgaataagaattattatatctagcttagctcaatagaccgtcagatgattattttggcttgatgtgtgtgctggtcttgccgatacgacaatggatagtgtgtatagggtaagttggcaaaaagaggcgatcagtaatggtgctactaaaatttaattttatctttcagttcaagcaagtaactcccccaaatagcttttgcttcctatggtggcccaaaaaataaagaagaactctctaggctcgatttctagtcctcaaaattatgaattgttggtttataagggacagtcaagtggaggcgcgctgagttcctgctactccattatatttatatcttaagaccttgtacggtaggagtgaatactatctcctccataagtctaacgcttagtcgaagtttgaattgttgcaagcttccatactttcttggttcattgttttgccatttacagaacatactacctggtcaaatacagtttctctatctaccctctaggaaccccaagctgaagaaaaacacttgagatttacaatatcacaatgctgagttggcagatgatttagctttcagtgaaggctgatgtaccatcaggccttcttgagcctcatccaccccgacaacaaccaatccaagcgctacacgactgattgctcagcacgatttcaaatgggatcttttgaagcatcacttctctatgaatattgacaaagttctcttcatttgggaactgtttcctgccgcaattgcgtcgatttcaaacatccgaaccaagacatgatcttatctaaggggagcattctttcataaaaataaagtttcaaagtttgtaaagtctatcttatctagaatatcatttttatgcatgcccatatattcaaccctgtaagagataagcttgcaagcataattttagcactggagcctgtagcagcttgacgcgcaatttcaatacccaacaaggcaacaaacgttttcaagtatgcttcctgaattctcaagacagcatctcgactaagtccaaatagttcaaggttatctgtcaacgatccgaacggaatactgccaatcgtttctccaaggtagacgcggagtaaggcacgcctgtactctttttgctcagcagctgtacagttttgaagaacccagtaatcgctggtggataatccaccaaaaggctggaattttgtcctgtgctcatagttggtcgccaaagggcgacatcttagacatgatatgaacctccagcgccaatctgcagagcctggagggatgtggacactgtgtacagatatcatagaggcaaactgctcaggattagaacaccacaccattcgggttcgctcatcgtcaagtagctccgagtccattgcagcggatggtgagctgtagtggaagaagcgcaaataaaatgctggactaataacctggaaggtgatctccgaacagatcttactggatccagagaggttggtcgactgcgataaagcttctggaatcgacacagcatagtttgaccgtaaaaccctaacccttggcgaatgttcaccaggcgtaatatatttcacttgatcgacatgtgactggttttcaactgctgcttggagtatcttggaaaaataccgctctagagtcctaaagcaaggtaagtctcgatctgaagctttgatgttgaaaacacatacatttctaccgtccttgcaggcttggcggtcactgtcttaattggttcttcccttgtctgcaccttgatcttctttctttgagtgagatagatcttggccgcttgtccaagaattctgcatgtgacgactgtggccatgggaacccaccaccatttccacaagaagacgagagaagaccaagtgcttgctgtgggtatatctagtgaaggcgaatgaggcttcacactagctgtcataagcgtcttattcccctttttcaaagtgattaaaatgctgacgcgaccatccgtgcttgcacagggatcagacgtatcgacgatgtagctggtgtcggaccccagaggcatgaagggtgagacttgcaggtccttgacaaacttgccttggaagcagtaagagctgccttttgcttgcctttgcagggagttcctcacgaaccataacctgcgctcgccatatgaggtgtcaagctgcagaatcagagccgtaagttccttgtcagagctgtaaagataccagaaagctagaggattattgttgttgttatggtcgttcatgcaaggtgaagtcaggaggtaggcataagcccactcgcttgggtcttcattctaaatatccatctcagcggatattctttttctcacctggtaataatcagagaggtggcgactgacctgtgtacgaagaaattcttctagcttatgggacaaggttaaatctttgccgcccctgatcgcctgatcttgaggccgaatgttccataggaccttgtaggatggccggtccatggatatcatgggcgagtaagtagcatggatgcccacaggaacaccaatgtaaaggtaagaatgactgaagtcgtctttgaacccccccgcgattcgtatgtgacgaagtacagaggggtacattattggccttccatgcaggcgctcgagctcaatcggggcttcttgcgtcccatcatcagatgaaggagcttgcttggccagacggcgcccgccgagcccagccccagtgggggcacgaaaggcctctcgagatgcctcgatttctctcagattttgagagatatcccaatactcagccttagtttggcagaaagcgaggaaaaggaaggcggttagagttgctgcacaggtcaataaattgagccccgcccatcgtaccagaacaacctgtattaccaactcggtagacgatagcgatattctcctctccagcacttgtctgaacaggcaagagacggccaagggagaatagaagatactgggaaatgccattttgttgagaaagcctagtgtagcacaggcagaatttaccaatgtgccaacggagaatgctcgagtcttgcgattaatatcagctatgccattggagataacatgacagggcagaaagctcagcttcgggatggaccgctttgagcaacacctgttcggtatcaagaagtggcgtaggtggggatgtctcaaggatcgtttggaggtaaggcaaggctagcccaattagcaaatgcctcataccgcgattacagtcttgggatactgtaggatctagcaaggacaaaagggctagttactccggttcagatccacagcagagggaaaagctacgttcatgcgggagtgcagatcccctgtgcacgatgaagagccatgcaacctgaatcggcatttctcccaaaagagctccggatagcaggggcgcaactaccgagagggcctgcctacgatcacatccatggcagcatcctggctgatgtaaggatcgcgatcctttagggggggcctttcgatttgagtcggcaattacatgtgatgatgatagaaagccaaacgtactaattgagagcggtaccttgatggtagcatgcaaagagcgggcaccaggcagatataggatccccagccaataacttcatctccaattactgggcaatccttgaggttcttgtaaacccccccccattgcaactgttctccgaggtcacgatctgatgacatctagttctcagtcccgcattgccattcaccactcgcagtggcattcatgatgccactatgtgtctatatctgaaaaggttgtagggccatcctagtgttggatgatatcagtggcgctaaattgaggcagcattagtggcccctctcccaatccttgggccgtaggacagcgttacaacgggccaatgttgtgaacagtcctctcaagtaaccgaaagcataagcacacgccatttcctaaccgttttctaactgacaaagctaaacacactagcccctgcctatcaaaattcataccgtcgactcgtgactggttagtcgcggtattttggcacgttccatactattttattgtttcatgggcagcaaccccacctgttgggggcggacaaggttgaccttcctactgcagatgtcgtggaagtagtaatatcactattcaagtataggcattactatttctgtagatcagcgggctggaggtttgtcctaatgcatctcggggtcgtgtataccaagaatcctttattctccatctgtccaatttcgatcttatgatggccctcgtatgatttatgagggctctggtcgttacccttctcttgaattcgatatcctgaacccgttctcttaacttgatctagacacgatggacgaaatcaagcccaggttttacaacgacgttgtcattatcggggccggcttgtctggcatcaatttggcatgccagctacagcggaagctgggtgtttctgactatatcatctatgatcgtgcccaagagctgggaggcgcatgggcggtaaacaagtgtaagatttcccaaattgtgctcggctataataaccaactcaacgtgttacagatccaggatgtggagttgacataccgggtgcactctactctctttcctggttcccaaatcctgcctttaccaagatatttccatcacagcccgagatcctgtcatatgcccatagcgtggcgcaaagtcataatgttcccaaacacattgtcttccagagagaatggaccggggccatatggaatgagaaatcttctacctggcttgtcaatctgcgtgatctagtcaccggggacgagtatattcacgaggctaagatgcttgtttctgctgttggaggctatacaaatcccaagctgccttcactacccggcttagattcttttcaaggacctgtggtgcataccgcgcaatgggataaagaatacgacctgcgcggactcaatgttgctgttattggcaatggatgtgagtcttcttaaacagtcgaggtcagtcaactgtcagctgatgctttccaggttctgcatctcaggtcgtccccgccattgttgacaacgtcaagtccttgatacagttcgttcgggtaagatgttcataaagagaggcacaccatcgcattatgctgactagatcacgccttttagagtccacaacattatgttccaatgccgtgtaattttgaactcggatggattttaagaacgctattctcctatattccagcagtgttggtatttatacgatggacaatatttttctttcttgagactgggctccttcagttctacaacaacaaaaaaggacagcagatgcgagagcagtcagcagtggcgagctccaattatattaagaaaactgccccaggtttgtgaaaagctgtggttccttctcataatatcagcaactaagaaccaatagagaaatattggccaatgttgatacctgactatagtcttggatgcagagtatgtacacatctcggcctggatttatttaatttcgctgactttgagagtagcgccggattctggattgccaatatctcaaggcccttcaaaatccaaaggttcatctgacaagagactcaattgtctctgttggagaaaagagcgtgattactgcgtctggagctcagcacaatgtagacttccttgtaagaaatgctatgccttacgggcagcgaatagttctgacatgttggggtagattctagcaaccgggttccaattttcacaatggcaaggcgataaaattattggccggcatggagtgtcattgcagcagcactggcaagaagtgggaggcatcgaggcttacaagaccattgctgtcaatggatgtcccaactttttctacatcttaggaccaaactcgggcagcggccatacttcggttctctttgcttcggagtggtatgtgaccatgctaaaggctgaatttattgggaaaaccagctgactctttcatccacagcactgcaaaccttgtggttaaacttgcccgcccgttacttcttcgaaaagcggctgctgttgaggtcgggaagaatgcagagattcgttattgtgattctattcaaatcgccttaaggaaaacagtattaacagacagctgttctagcgtaaggcgacatttccaacttcatcatatcgacgtattaaaaggactgacattccaaaagcaagttactgataagacagggtggaactttttcaactaccccttcagctctcttagcatgtggttcggcacgcactttcccgatatgaaccattggatctaccgataagaccggcgacggcttttgataaattgaccagctggatggtcacccctggagtttggatagataggctggccggttttgtgggcaagagacgatcattatgtctgggggcacatagtgggacggggcgatgccattcgggcttgggaaggcgttgactgacggcgtgaataagctgttgacctgttgaggagaagaaactaagaaatgggtttcaaacctccttcatctagttagccagcacatgtagaccgttgatgtgttatcgagacttttcacgtgttaatgtttttggttctactgtggcctgggcggtgctgtatcaaggaaagactgcctgaaagtagcctaatgtccttccactttttaccaaatctatcttacgctaatgctaatcctcgtagtcgatgcctctatcagaattaagaggcgtggcgactccactccttagttcaactacctcggacagttcagctcagtacaatgtagacctctagtgaactgccgtattgcctgtcaacatcatttagcgtgaaattagaccactgccacaaccgtgtagatcatatctccttcgtctctagcatagctagcttacgggcgaaaggatcatcaggccagcgcacgtggttggcgaaggggccctgagggaattccttgaagctccggaacggggctccgaattccaaaattccatatgtgtaggtaggaccttgctaatacggaaagcagaatgcgtttgattgccgatacgcctggctggatcttggtctagataactctcatggatcagcatcctacaatcgccaaattgatccacattttcagggattatgaattaaatcgatttctccggcataaacgcaccgagagccgccgaacatgaggcagactgtgaagtagctgttcatttcctgacgcgccctcctctctcttttgtgcttccttcatgtcctacccagccggaatcttgtctttagaattccgtttttctcattttcttttttcgactatcgctgatgcttgcccttgaattctctgtcttctctctcactttgcttttgatgccgctggagctgccttttgagtttttttccttatcatcgaggcttaggcttccaagcccaaaatctcttcgcctcctgcgtctgaggctgagtttgtagtactagtcttttttctacactgtcatggttgtcactcaacttcttctttgatctggtcataggtgcgggcccttatctgtctttatctttctccttcgccagttgaattgtttgaagaggggtatctcaggccaagcaaatgcctccaggagcacgtggacgaaatggcccctcctttggctgcagagtatcctcacagaataaccttgcgatgtgaagttgtctgagtgcctgacttcttatttcctgaccgaatcttcttctcttttttgaataccttggacttgagagtgtccatgttctccaagatgtttttggctcaagtaatctaatgcagtgatctagtcccaccagaaaaagaactagatccattcaattgaagctggacaacctgtatatctactaacaaatacaaccatataacgatgcaaccggcttaaatcttgctttacatgatgtgctgtatatcagagattaacagtgagcttctaagcaatatttacgtaaaaaggaaactaatttgcgtaatttacccacttgacttgtatcctccagacgcctatctctggtctgcacaataccgttttgcttgtctacaatctaagtatctcacgactggcactattaaaaatgtatctttattttcatttgcttcttaaatgtaaagcatcaacgaaccaccaacactaaacctcattgcccaatcaattttctacacaaaactatcgacgcagaatgtgtttaccgttaagaacagacaattgtgcagtaaggttaccgcctttttcttcttctcacacgttcgtcagcaagccttaaccttgaatattgtgttgggggaaaaacgaacaacaccacggttcttcgcaagcttgaaatacagactgctaaccacaccaaaatctaacaaccttccacaacagctataaaaaggaggttttgagttttgtgtgtaatcttatttgatcaaatggttcatgtttacagcaggtcaattgacctattgtagctgccgtaatgatgctaaaagacgtatctttcataaaggggtttttttaaagtaaaaataagaagaggtaaaaaggatgtcttttactacagatagtaaaaaatagctaatttgtctaacctggccaaaataacaagtgggccccgactcaatatatttgaccaagacgtcgtgcaataaagaaccaaagctttatactgagaacgataatcgcccatttggaagcgatactcatcttatagtcttcagatattaaatgatatcaaggcccttgcagagaagttgggcttgagcgataggtataatttacccagtcatgcctagcgtcagaacatactggccggctacctgaatgcttgtaagaaaagtgatttataatgtgtgcgtgcgttagatacagtaagaagaatatagtaaatgacgtgcatccttgaacaataatactgcttcgggtgatcgatcagggtttggccgatgtagggctttaaaggaaagaaattcgccttgcaatatgattctcacaaaattggcctcacacagtgtaagcagacatctatcgtcttaaatataaggccaatatccagactatttatctaagcctcacacactttagagccgccaataataactgtttgaaagagtccttcagcatcccacttctcttgagccttcctaaactgcgctaaccgctcatcaccaccaccgcagcatgtggagcaatcaggattttagctagggtcgtttcaccctgagaaatttacacgctgtgataaagtttagcttcattgtttacaaagtatgtgacattttatctctcaccagcaaaaacccatgtagcattgtccatttgaacagtcgctagcgctgccacagtgggcgttgaagttttgagaacattggcgtgtctccaacccagatacctcagtctcgccggtaggtatagccagaacaaggcttgaaaaagtggcgaggataaagtaagacagcttcatttctgcgatattggtatagacttcttgaatataagtgggagcgtgataatttatgctgtaattaaggatgggagatgaaaagacaaaagcaagcggttgaagaaaatggcggaattcgtacagcatttataatttcaatgcaatgaatttaatacattatacttagtatatcatttgtattctgatgacattcccctactgttggcccccagatccctggagtattccgactcaagccgtgcgtaggccctgtggcaactcctttgttacagtgtcctaaagccagggatgatcttgcctgaatttgggctgtgaaactctgcctgttcaagagctaggggctcagccacttcacggtaatgacttctccccatccacggagtattatgccttgattagtagagagatgctccaacacggcattgatgtatctcttggacgtgccagagcacagatcttctgtcatttggcttcattactctacagtccaccttccagaaaacgaggtattatatctcaaaggattgaggaaccaaaatattgtctgcctcacgtctggccccttaatcttgtctcatactcgccctaccgcaattgttcagaaacaatctctacctccgcttacataactatcagttgtataaaggtagaggaccaaaatctaccttccagatatagcaatctccatagagtagggtacagacagagcgttgaatgttgtggggctctgatatcaacagcaggggaaatcgcccataactaagggttgaatgcgtgtgtgtaattgagtgttgagtccgtggcattacaacattattatccggccggtaagattttacgacatgatctttgcacagacttgattgtcttacatatattgattggagtgcctcttataggagtgccttaacctgtcgatggggtgattagttagaactaagattgtgcatcaaacttgcaagcgccacacatgactcatgatagttcccatcacttgacaggtctgccaaggtaacatccgcatagggtcagggatttggcgcagaccttgaccctctggaacgagtttgaggtaaacagacaattgaacattacagcactatattgaactagcagattttatgaaccttgtactgtttttctcagtgagcagttctgaattgtttggtctcggcaagcgctgcacttacagttaggtccgattcaacgcgagcagacggatgacattcctgtccatgtgaacttcatgcatgattgtatcagacccacttcatcttgaggacatctctttccatctgacactcaaggcctaagactggattcaacaaatcaggcggttgcgcctatgctgctgttatgccgcagcttacatgtcccgaaacaagcgctactgttctagagttacaggagtcgtcctcgcaagggtgtcgagaggtttcactctcactagttagacgtgtcgtatttgaagtaacttgtgcatttcaagatcttcccattgacaaacatttcggatgatgtacgtcagacaaacttccaattcatgacttgatccatctcatccccgatgggatgaagtttgtatcgaggttgaaattcggaagcgtaggtggcagattgtcgacgtcattccaagtagtggcaaactggggagttgagaagtcaggtggcaggttgctgatcccgtcgtggccctgccgcatcggcaagaaaccgagcgtgcgcgacatggggctggacggatttactacgtcgtgatggacacaatcctatcctcaagtagaagcatctacgtggtattgataaccaaagtcgaaggcattttgataattcgctcgatggagagtggaacctccttgcagtctacggaaatgtcatgaataacaaattggtgttgtcgagtaggtaataccgttgtgaaatgactgttccgcctgagaagcaaatgaagcaacatcacctccaacaggcaggctagggggtggtgataccatcttcccgctccattctcagccaggaatcagccatgtcgggtgtgttgtgacacactcggatctgatccctgtcttcgccacaatcacctcctcaactgaggcgggtgaatccgcattcgccgtaaaggtgtcgggctcgggataatttacaatccgacacagaagcaccatagttagtgtgaggcatctaccgactgcctcctccaagctgtactaccttgtttgagcatatttccaataggaattctcagtataagtttcgagttcttaccaccgagtagtacgagcggagaatacaacgacgcaggggggggacgactgttatgtcagccttcggcgagcgccctcgcgtatccggactcggagtttctgcatttctgcaggggttggtttcggcataaaccacgcaagcagttttccgagactaggtaggatgtgttgagcatggtgtgcaatcatgatgacgtgagcaggaaacatcaagttgtgcaaaaaccaagcgactgagcggtatataaagccagtatgctgttactgttgcacataggcttgagacttcgaggctttttcctcctctctcctaaatccagacgttgtttctgatggtagccgagtgtacgaacgtaaaatctgagacgcaacgtgcctaattgataagacgttgttggcaaggtaacgactgtcaaaattgaccgttggatcctttcgagtggcacagcttaattactaacaaccaacaatacagtctgatttatgttgttaggatcgttatcgcacacctccgttgcaataagtccctcgaagaatttaaaagaaagtctcaatttatatacactccatgacttattaattaatcactcaattgaatatgttatttattcaaccttgtccccgagtaacgcacgatgcaatggggccaactgcatgagtgccggtgaaacagttgttcccgaacgtacgcaagttccaaagtcccatctggcatcaggcccgtgactatatctccgctttccgcgataccattttcattccctacgtcttaacaatctacttgaaactacaaccatcatttggacttgatggaggcttttctagcatcactccggcccgacgcgcctactttgcgagaacgagaccctctggatctcgacgaggccacccgcgagctttatagacgagccatcgctgccccgtcgtctctcagcgatgcagaacggagaaagatattgcgccgtccagctcgtgaagaggaagacgcaagctcccgcgagttatgtggctccaccatgtccgagctcatcactaaagccattcaaaatcacgaatcgctgacctaccaagaatcaaagttggtaatgggccgccctaaggagagctatatcggacagatgctagatgaaaagcttcggataagcgaagatgatagagacttgctatccaaggcaatggaggccgcactcacagcagacgaagttgccgctcaaacgaatgcctttgccattcaaaacctctggcgtgagcaccagaatgctgccagggacgctttcagtgattttgatcgtgctctgatcaagagagccttacatataccgtggcaagaccacatcataggcttggaagacccaattcgcaaaacagcgacatgcggatttgtggtgttttactcaaatgcggtcaactggccgacattcaacgagcggatgcaagcggcaacgaagtacgggttcgatctttatatgtcagggattaaggactccatcagggaggggttcaccttgctcggggtacagtacgacgacgccgaatcgcttcaaagccgcttcgccgccatgcgagatggggatgagatccccaaaggcttgaggcgggatgcatttctctatgttgacgacgaggcgatgcaatcccaggaatcgagcaggccgttcctatggttctgggagccccaggagacagctaagccgctaaaggtcaacgccatgcacatagcaccgctgctaattgcgcgactgacacagcgggacctcccaacagaaaaggctcagaaatggcctttcaggagcatgccggatctagagcagatgcacaaggtggcagcccgatcgatgaatggggctggcgagcgtgatggtatctggcctccaagcgcagcctcaatgtaacatagaatcaaagaagcaacaaatggtcggtacatgacaaaccgaaactcacaagctagaaagactctagatctatggcgtcaataaccactgttttaagtaaactaaaagtcttatcgtacatggcatcccgcgaggtaaaactgcccatacatttgtgtatcgacacctacacaggcgtagtaacacgggggggggaggtggacggatctgagattgtcttcagttctccagtggctagacagctagatgaaaactgggaatgccgccaagcaagagttggcgttatctctatcgcctcccaaactaaatcatcagcacaccactacgcatcaaattgacaaggcgcgtctaggcttgatgtacccgtatccagggtaggctgcaatgtccaacaggagagagtcagtatgagtagtcgttatagagattgatgcaattcgatctgaagacctgcgggttctgcggccaggatataagattccaccgtcaagtcaacgcattaccgagggaaaactaaccaagaagtaaaattcatggatactgatacccatcatcactgtaacggagctgcacgtatcactgggtacaaggaggccgctgccaaaagctttaccttttatagatataaatgggtgagtttcgccgacaaggacacgctcaagggaggcgtcatgacctggactcttggccataacgacaagaagttctctgctttgaagggcctgctcggcattaatttccaagactgcagcagcctgacggaacgcgctgaaaagaccgacacaggcaagtgggcatcgctcaatggacaaaattgtgtcatgacagaccacggaaacccgcccaagtgtccctctagctatgacatggcttccaacagcggcggcttctaagacacacgcgggacagattcaagtttggccagaaccaatccctttgatggatgatcttttttattttgaaattagctggttcatagtaataacatctcgaacatatcatgtggcgatcaatgcatcaaaatacaacaaagcaaacgctgaaagaacaagaggcaagggaacctgtcacgcatgcacgcaccctaatgtgatgcgggcagatgttgcaagtgaacttttaaaggtgacggtaacatgtttgattaaagtatctaaagaaaaactagatcaaacgcaccgcgaaacctttctcgaaacaagcaatcccttttctgctcatcaccggttctctccgtctaccagcaataaaggccatcccctgtgtggaaaccaagcgacgtgccggacaaaaaccacactgttacttctcgccagaagcatatacactctaggtattggttagatactattcatcatagctcacgtcgcgaggcttgcggctagccttgcgtccaggataagggggcggtggtggcgagggtgggtaaggcggcggttgaggatacggcggcggcggagatcctccccttgcccggggttcaagatcccgctgctcaaggtccaccatggcttcaaagccggtctcacgggagaaaatgtcgttgtcgagagcccgttcaacatttcctggcacgccatcaccggcacctggctgctgagccccagctacattggccgcgccaagcagcagcgttgcggccgccacgagacgtgccaaagacaccatttcaagagagtggaaggggtcaactagcagatgaggaaatcagcagagatataaagaagagtgagaggaaacaaaaacaaaaaaggaaaaaggaaaaaagatcaaagtaaaatagacggaacaagagccccgtctgatgtcaaaagtctgtttttttggttgttctgagtagtgcagaattgtgtttcccgacctgggaaagcatgtgtgttttatagatatatcgaaactagatgcctaggccactttgatatattgagcctcctctcagttggcgacgtctcgggaaacctgcactagatcatcctacaatttcgccgggcattccgtcttcaagccttttcatgacgccagggtcgaaaaatacatgggtgggtagggtcatagcccggtgcagatgagactcatcattgttgactgcgaatacatcgtgcgtcgtatacttgttgctattcggagtgaatggtagatccggtctacctaaaagagcaggatgagccgtggcataacatggccgactaaaaattgagcaaatgatagggacatcaatgctcgccaaatattactgccacagagccgcgcaatatgcaattaagattaggaactatggctgagcactcggtgcatctatccagaattgcaattgtatattactcatgcgaaattggtgcactcgcgtgatgaattaggaaacctaggaatagtggagaaaataatggcaagacctcggcacatactaccgaattggaaataatgatcacgctgtgaggcaactgcttttgcctcaaagcaaaccaacagaatcacctcgagtcactttacgacccgcgtctgctggttgcaacaaacatttggtagaagccaaaggagcctccaacaagcaacggaacaaggacatcgtcgagcactgcctgttatgtctgccaagcttgaagaaaagtgctacctcgagacatttgtagcccccagctggctccctggtggcaagatattctggtatcgtcgcgccacagccaaggacaagtttgagtttgccctcgtcgatattgaccgacagtcagtccggccagcttttcaccacaatgacctggccaagcagctagaaaagcatgcagggagcaccatcgactcggacaatctgcccttcacttggattgagatggaggatggccttgtgcgtttccgtttgcaaaagcaaatgtgggagtacaataccgaggaggatctactacgcacatggaagggccagttctcacaggggaatcctgcactggcatactggggtgcgccgaccggccaccagcctggacgacggagagttgctgtgagtttcaccaacaatacaaggtcgggcctcgacatgtacgctgtcaagccgagtggagaaacagcattgtacctcgatatcagccaaggccagacactcctgcagagatcgggcgtcggcgctgtgtggaagtttgttggcagcggaagcagagtcaagggtgtgtattgcgtacccgacgtgcagcacgatgctgttgttctcgacgataccaacattgacgaatacatgggaacctgcgactctgacctccctgaaggctgggaggaacgtgtaactgacacgggtcgcgtttactatctcgatcataacacgaaatctacgagttggcgtcttcctctccgtattcttccaaccttcagtcccaaccaacaagagaattcaccccaattcgagacagagagtgacgattctactcagtctcgatgcagtcaagtggcagaggtggagaagagcggcgacgacgaaacgacgttatttgttcgtcaatataatgtgtggatgaaatcgtcaagggaagagcgtaagctgtccagcgacggcagttcagagtcgccttatgctccaaacactatacgtatttcacctaacaagcagtcggcaattgtgtggcaatgtatggccgccgaagacgtgagtatctcgtacaacatagactatacaccagataatcagttcctgcccaagctcattcagacatcaacacaacttcctggggatcccatacgggtcgaccgtccccgactgttcagcctcggtacccaaagtgagatttctacgactggcgacctcttttccaatcccttttccacccatgacctgggctggagtcgcaaaggagacgagtaccgctttttgtttatcaagcgcggcctccagtgtaggagaatcctcggaatcaactgcgctggatctgtccgtgttttgcacgaggagaataactctacattccttgacttaaacaagctatactaccacacactcagccgttctgacagaataatttgggccagcgaggaagatgggtataaccacctctacctcatcgacatgactgcaggccacgtacaaaatcagattacaaaaggccgctggaactttagatccattgagcatattgatgaaaatacggagcatatttggctctctgcctatgggtactgggaggaagaggacccatatcatgtccatcttgtacgtgccaaattcgacggcactgagtgcatttctctaaccaagggcgatggtacacataactggagctatccttggtccgccaacgaccggcattattttgtagacacatggtcacgaatcgatcttccgccgcaaactgtcgtgcgttgttttcggaccggaaagctgcaattcagcctatctacaactagtcaattggaactcttgagccgtggatgggacccggcggagagattcgtggccctgggacgagacgggaaaaccaagatatatgggctgatcatccgaccaccaaactttagtgttgataaaagatacccagtactggagactatatatgcagggccgcaagacttctacacggtcaagagttttagtggcatctcaggccaacggcaatggtcgaatgatggatatgtggttgttcaagttgacggcatggggacaaactggcggtccaaggcgtttcatgacatctgctacaggaacctcaaggacgcgggtcttccggatcgtataatatggatgcaagcggcagcaaaaacacggccttggatggatctctctcgcgttggcataattggttcttcagctggcggccaaaacgcggtgtccgcattgttacaccacggccacttctacaaagtggcagtggctgattcgggatgtcacgataatcgccttgacaacatggactggagtgaacaatggttgggatatccagttgatcaggcgtacgccgataactccaatattacgcacgcggccaaccttcagcaggacgggaggctactgttggtggttggtggcttggatacagttgttaatcccgcatccactatgcgtctggccaccgagtttaatcgacatgaaaagcaatacgagttgctcttcatccctgatggcggccataactgcggctcagggtctggaaggaaaaaggtcgcaaggtttttaagaaagcatctggaaccctaggagacggagcatgcttttttcataaccttggttcttgggaaccttggtatgcttgggctcttaaatataaattacattaaataagtatcaatcattttccacctcaatattctcatttgcctgccaaagctatacagagccttgctgctcaacttcacttcagctccttcatagcagtcgcaccagatctttatcactccaagttctttattgggccgccgggtaaatcgtgccaaatggtcgctccccaaaccaacacctggcatctctcactcaagtctcatttcacagcattcccctctatcttcccactgtaagacctattctgcaccaaacgtctagtagtatgaatctcgagtgttattaggtcgactcagcgccgtggatactgagcgtcgtatcattgtggtccccgcaagaggctcgaaatgctgctcagggttggccggttgcgtccagttcgggcggcagtaattgttacactcatgctgggaaaagaaagagctgatacccgcagggccaagatccgtcacaccatactcgcgtctccgtgacagaatgactgggtcggaaaggacaatctcatgttgatagatgcccccttgaaggtcacaaaggacgaagaagcctccggacacgtggtagctgaagtgactgagcgcttgcatcacctcgccccatgatcccgagtcattgaaccagccactgttgctgttgaacttgacataattgttgatgaacggttcacacaaatgcttcgtgcccgcccactcgccggcttcatcatcaaatgtccataccgcaggcacattgattttgacgattttgttgataatgtttaggtcgttaaaacgatccacaatctcgagcgccttgtctaccgccttgatgtcaagggtgaagtagtccgactcgaagacggcgcctgttttgaaccatttgacgacacttgcctggccccgacgcggaccagatgtatatcttcctttggcgacgtagcggaaggatccctcgctgaatggatcgtccagctcatcacatggcacctcgcatcttgacgaatcattgtatcgaccgctggccgactgtgtcgctcgcggggtatcggatctgtagccgtgaacacaagctgcacatcgcgagatcccttcgccttttgcgtattgattggtggtgtacgacgagcgaggcaagtcgcggccgcatgaggcgcattcacgcatggtcagagaaagacagatgatggagataggacttaggacgacggcgaatactttcaacgacggcgctttcaaatggaggtaaatcttgctgcctgaggcctttcacggtgtttctggcaaagttacttgtcgcgggcgaggtcgatcgaaaatacaaccaatcaaagaaaaataaattgcggagtcaaagctagaaggcttatgttattcgagtgttggtccaggtcttaaaatgcccaaaagacattcctcacgatctctttttttcccccaacagtcgtgaacagcaccacaccgccattcgagatgggtctctatattcccgacgagattctgcaacatatcatgcgttattttctctccaaggagcctcgcaggctcagctcactgaaatacccgtatgatgatggaggatttgatccctcatcgcgcccgacagatttgcattcactctgtctggtcagccgtcgattttgcgatattgctcagcctctactttaccataccatcaacattactgatgagacaatcgacactgacggtccagggcagcagctagagtggccgggccgtttgttgagaacaatggctgaaaatccgcaccttgcgaaacaaatacgtgtcctggccatacaaagctatacacccggagcagtatggtcgaccgacttcccttgggacgttccacaatctctgcgatgcgttctagaagatgagatccaaaaccccgaagtccatgcagtatcccttgcgattctattttacgcaactatggtcgagaggatcatactttcctcaaacgatcccgatagtcttcaaatcttttgggttatatcatcatggttaccatatggaaacccgccatatgagcatgctgaaatcggctcgaatctcacccctgagtttggccctttcgccaatcacggacatccccgactaaaagagatctgcttagatggctttaatgaagattgtatcccgcttaatcgggtcttcgtggatatcatgaaaaaacctggactttccaccctttgcgcaaatggtggatggtggagtccaaatttcttcaaccctcctaagctccctgcaggcgtgctgtctgatgactggccctccagtttgaaggtcttggaactcaaaaactgttgtctagacggctatggtttctcatatatccttcaaaactgtcctgggcttaatagtctcaagattcatttagccgagccggaggagatacggctaggtgacttctcttggactcttgacctcgaccaaatcgggcaaactctgcgagactatggaagcaatttgacctatctttcatttaacatcttcaattttaggctctcacatgaaccaactggtcgaattgggtctttatgtgctttgacaaacctccgccatctacgcttctctcggaatgacttgattgtttctcaagaatgggttgaaccacagaagcagagtattttatctttggaaagtattcttccctcatcaatagtcacagtttgcatctcttatattgaagctggcattacaccatcaccgccaactagtctggtatttacagagatagagagtcttctagctagtgaacgtttacagtctcttgaacgagttgaaagtatgagatacatttatgattctcaggatgaattggtcttattccgaactgagataccttattggtctattggttcccagagaaaaccatccaagattcagaatggtgttattgagtttatgtatatcactaggtttaggggttcaaaaagtgattcgttcaacaactttgggggaacaagaagcgaatcataatcaggtttatttagtttttctttcggtaacactaggagctccttatagcaggtggttgctgacgcttatattcgtccatttttacgacatcgaacttgatcctaatttatgtgggagggctggacaaatgtgaaatatgacttgtgaatcatgcgatattgcccatctaagtactcgtttaccctgttggtatgttaaaagtctgaaagacatcgcccaataggcaatttctaattgatcatatatcaccgacgaaaccgccattccaaatgttgcttgatatttctgtggagatcttggatccttggattacacaatgtgttgtctcgtccctcggctttatcaccctcggtccagatgatcttaccacctccgagagaagggttacttggaaaatgaattacaaataattatctctataattttctacgaagcgtcaaggctcaatgacatgaattatttagcttttaaaaacagatacatttactaaaatgacttgagaagatagcacaagatgcggaggtacgatatatttttcaacatcgtatcattgttttctttaaatctcacttctaccagaaaacccacaccctgaacacgtacttcggactatctcacacgggcaggcaggtggcgtacgcatccatgccaaacacccatcccactatcgactccagccctaacctcaatcctcgaacgatttctcactcatgcgctgtagtagcggctcaattgcctgaaagatcggcgacctactcgtctgggagagttaagatgtaccctttccggagatcgaccaacgactcttccgagagatggacgacttagtttcttgggagagcggtaactcaatcttcccggagccggagagctatgaactagtacaggagagcgacgctttagtcggctgggaaagcggcggcgttgtcgtgccaaagagcgtcggcgcggagcgggcccgggagtaggcgatttattaccatcagccggtctgtgcaccaacgccgaaggtgtagtaggctccggtgaatcctcgggcgactgggtcggaggtctcttcctggacttttccaactgctgcatcgtgtcctcatgctctttagtccactctttctcgacggatgagccgccataggtgcttccagatgacggtgccttgtcacctgcgggcttaggaggcggggttgtaggattctccttggtcttattctctttgtcctttggatcaggacttgcagggcgctccttagcctcggtaacaggacttgcaggtcgatcctcagcctttttcggaggggcgcttgcaggctgcttcgtgccgggaggtggtggcagtaggtggtagtcttctatcctggctccgtcaaaatcaacacccaaattataggcgacggtttggcatggataacaaaggcgctgtgcctccccgccgagtttagggagagccttagggtccacgttgtgcagaccccaagccacgatcttgctgccctccggcttgcctgttttcgtgtttccataggtgcgatctgagactggtggacccaactcctctctgtaaaagtatgcgccgttctctgcgtcagtcctcttgaaaaggtttcgcgcttgccaccaaagaggagctttaattttgccatatttctcctgtttgatgtagtcgttgaaaaggtagccgcgcattatcgtcgacatatataccttttgggttttatggtcgtaaaatgcagctactaatgcggatctttcgatcgtgctcgcatgtgggctgagtcctgagccagttgaatgctttgctcgcctcggtgtataaatctgtgagctccattggatttttgggtgcaggaattaccttgcgccaaaaagcaaatttcgcgttctcatttggattggcaacttccagtacggttgtgccggtagcaggcttcaagtcggggccgaggaaagcacattgcacgaagccaaagagccagaaggcaagagcgagacatcgcaatagttgcatggttcttattttccaagctggggcccgtttcgagagttcaaatcagcgcgtagaatataagtgtaatgcatacccagaatcgttcggcgtagacacgaattcaaacagaaacaatgacggaagtcgagtcaggataaggaacagaaaacagtttgtaaataaaaagacgaatgatgatggaatcagtaagacagacgttcctgtgaacgggaagcgttatatataaaacgcaactacctcttcgccagtttatttttacagctttgtatttcttcagctcctagacatgattctatttttatatctagactgcattagagaacagaagtagaattaccaacagagtgatttaaaggactcagtaactgcggagtcttctgctcttgataaccaacagatattaacggatacccagtagtaatatgaggtggcttggcgaccagttggttgttggtcaccagaaggaacctacccctgttgtgaggccgacatcaggagtctaccgtagaaagaggatgctgctcggccaatatcttccaagaatctactcttacaactttcctgcccgaagatgaaacaaaatctcatggaagagtcttaaattagtcatggacgatgacctgttgagcctctatccccggcttcttgttcatcggcccttgtccaaattagcgccccacgtaggattatggtccaggatccgatgagacccgttggccatggtcaatggtaatattagaacaccgtttgcgctcgtgaccaggcaacagccaacacgctgaccggcctgggccatctcttgttgcggatttttttctctcctgcaccgtccactatggggaatggctaatggtacattctcggaagtgcgatgaagtaagagtactgtcaagtagtgtaacagggactacatggatgtaggaacggtagacttttccaagtttttagcaatgggatacgtcgttcctagctgctacagcgtgttaaggtctgctagactccctcggtaatctcgtcaggatagattatccaatctccttcagcccgaaaccgggtgccatatagcttgttactggttgaagattagcacaatgaacatgggtgctgtttttttcgtgggctgaagacctgccgtctcaattggcatctttcgcaacacaagggagggaggacatttgctcatattgagcctagaatcctagctgtcattgactttggcgccagggttttcgagctggagatgcaactcgctcctagtgcatgtctttgacctgatttatcgtctcgctggtggttttgccctttaggactggtttaatgataaggttcctgattacaagcactaataggtatttcctattggtagtttctatcgttctttcaagcggccaaattattagccaaatccaccccgtctgtttattcgctggcaggcctctaattctatcagtattgcatttagataagattttcacatgcatcttgacgataatacccaaggaatatgttgccgaagagaggagagtagttatccagggatgttcgctcaaagcgttcaatatctatctgaagcactcgctatacccaagattaccaatagttttattactaaagttctacatcgtagaggctgcgaattgaaaacttacacaccagttagcttggttattctatacacaaagataggccttgcccccaatatgctcccatttgcaatagtatgctcccacagaaccaacgcctgagctggtagagccggtagaattttaattagtttagtaggcaatagcacctgaactcctaatgaggcggctgtagtaacccctctagtagatgtcacaggagtatcgcaatgagcaacggcatagaaagccctttcttagacttatgtccgcctaatgtacttctattcattgtactttctagattttcaataccatctcaatactactacaagttatataagaaagtttaaatcaatttctatacctttaggcctcgcgtagcttgtagtcaaacatttggttagaacccaatgcatctttgtttcggagcttttgagctgtctcaactcccgttgcaggaaccctatattccagacctttgctagcagctttcaaggtaagccctgcaacggggtgcggaaatggcagataatctggcatgattcccaactggaaaagtacagtacactggtcccacgatatgtgctcgtgatagagacggtcaccgcgaatatttaccacagcgaccacagggatctccaacttgcggccagtgggaggcaccccgggcagtcttagatattgttaggaacctaatgtattctgcgccaaggttgggaagttttcacttacaaccaatccaactgtttgtcatgtgtgcacttaaagatgaactcatcaataacacggtcaataccgattgatcgactgatgacctcggtgtcaacatcatctgggttttggaagatgaagtggtctcggtagaaggcagttagagcctcgcgtccaatgcctcctgtaagctgcccaatcattaatattattgactgtacatcaattgtacgaaccatacttactgtcgtgatgtgatttacatacggctcctgtaccatcgtggccattgtgcactccacggagcggttctcaaactcgtagtaagtatgctcatcccagatggcttcgagatcaaagtagggaccctttgtcaaaggtttgaaaaagctcaggtttcttgagtgtgaaacggactcgagagaatacttgaaatctttactgaacggtgcggcgaaaagataggactcggcattggggtagtcataggccgtgagcttttcacctctaggcagaagcttctcggacttgcctgccagatggtgcaactgagggagtgatgtctgggatagtgcttgctgttcttcgagatccccgtagaccacagttccaacaatttcgttcaaggtgtctattgtggatgcaactttgttccacagctgggggtcgtaagctaatcaccaggatatgttaatgttatgttacattctgagcataggtaatcttaccaactaaaccaaccaagcccttggagtcaatagtatggctattccgaagtccgtcaagagcaatatccagtgcatttgtggcatggtccaatgcagctgctgtaatttcgaccgtcgtaaagccctcctcggcccatttcatgacagggcaaggtactccattttctatcgccaatgatgactggccagtgatgccgctttgggaaactatgacaatgagtcctggacctttgcctctccgagttagcgggtgcactactgtgatgccagacgccaaaggctgcagcgaggtcttgggcagaaacgggaggacctcatatttgctgtcaatcatagctgctagtattgcctaagaagttgccaagttggaagataaaatgagcacaataaatctgatttcaatggctttagaacacaattcaaagcccaatcaatttggtagatataagcatctacactacatcgttagttctcacgagccccagaatagtacctcggaaagcccgtcggaatggctcacgcgatatttccaaaatcatatcatgacaaggtttggcggttgtccttgtgattatgatggactttgactttcctgaaccgcttgagtattggggtatccggctatcccgcaccacctacctgttagattaatctgcccgtcatccatccgtatctctctccggtttccccgctcgatgttggggtgggacaccgggaagtccggaaatttaggaacgcggcccggaacagttcctaagtgccgcggctacagtgcgaatatgtctatggtttcattttgacccgcgtatatgccagggtagatgtagcagtggtgtttcgaccaaacttgaaatggctcaacacatgtagggttcattgcattacggcaaaaataatccgtgcaacccacatcccaacctgcaacaacaacttccctcgaagatgtcgtctcttccaccaagcgattgctgcgcaacaggtttcaaacacaagtatgatctctgcgctttgaccctctacagcgatttggaaggttagtcgagctaatatcctaaacaatgcagtggttctccccagggaaagacggtgaagcttgccggaaaatgggacgcctacattgccactcctgctccaggacagcagcgaaatgacacagcgctgctctacttgcccgacgtcttgggcatttggatcaacagcaagctgatggccgacgagtttgcgagcaacggttacctctgcgttatccccgacttgttccatggcgacgccatcaagatcaacgactttgagaaaacggacgttaagaaatggatcgagcaaggcaccgacggatctcagccccatacgccggatacaatcaaccccattgtctctgacgctatccaaagtctcaagaaggagtactctgccaagaaaattggtgttctaggatattgctttggggccaaggttagtacaacgctcaccttgtattattcgcgccggcgcctgatctagaagctttagctaacccaacgcttgacgaaatagtttgctgttgggcatttcaaaaatgatatcgatgcctgttttctggcccatccaagttttgtctcggacgaggagttggctgctatccaaggcccgctatccatagctgccgctgatactgatcccatcttccctgatgagctgcggcacaagagcgaaaatattcttcgaggaactggacagccgtggcagatctgcttgtactctggggtagcccacgggtttgccgtacgcggggacctttccaagagagcggaacgattcgcaaaggcgcaggcctttcaacaggcaattgtgtggttcaatgagcacctgggccagtaagatgttaattctctactgggagccccgacgtagagttagatgttgtatcattctatcatcttagccttgccagtgagcggaagctattgtcttcgataacattagagtcaatagacctgtttacaccatttgttggaactattcctgtctttatcacacatgttgatcaattctggacccaatttgaaggaagccttattctacattcctgctgccagcacgagactcagttgcctccctccccaaagacacaacctaggtacatctacgtcaagacggcctagacctaaagttcaaactagtctcgctaaagtaagctggcgggatattgtaaagatccaattggtgcagggcccagtgataacgatttccccgcattgctgtgctctactggaaaggagatgtgaagctacctggccgccagctccctccttgcctatcagggtcccagataaaccaaggataaaaacccatcaggtcccagtccctccccccttcaatcatccaaccctactagtagattgtagcctgtaagatacttcccattccacagactgcctgatctgatagacctttgatgccgcggagatcccacacatcgatcaacacttgaaaccaggccaaatcaacaagacacttgcccgttctctcccacaatatccatctcgacagtccgtggcgcttcatcccacctggcgcgctctgacgcgcactcttgtcatgggcggcacaaagcgctcatcggcgtccgaagcgcacgaggcgtccaaacgacgcgcgccctacgctccccgggcttgcgatgcctgtcgtcgacgaaagggtcgttgcaatggacagaagccatgcggatactgcctgggccgcgtcatggaatgttgctactcacacaacccggaggagcgccgatcgaatacggcacaaaataacaaagatgctcaagaccaagctccaaagccaacggactgggcaccgaggtaagccgtcttagccagcagatttctcaaagcgttactaacgtgttcataaatcggacagtgcaatccagtcactgaccgacctggtcgccacattgcagggacagttgaatgccatcgcagcacacaccaacgtcttccccgccggaaatgggagccttgacaatctagaagggatggagccaatttcgctcaaacaggtccaaagctttcctgtcagtggcatgttgcctgtcccaacaatccccccggcggtctcgaaacgtacatcgcaacgattttacgggccaacgagtcctgactacagtctgaaagccgcccagcgacgggtgcaacagatggagggtagtgacacaagcccaagcggccaaacggtttccaccctcgatgatgaccagagcgaagacgacgaagaaaccagccccagcgtgacgggtcagatcgcaaatgcccatttgatgggacacgtacgaagcacagcgccgttgcaatttctggctcttttcacgaggcacgaggccatgcgcctcatcaaggtataccacgaagcgattggcgagcttcatcccatctgcgacattgataagctcctagaacaaatggagtggctgtacagctggtcaaatggcacacgggaagagattgatcctacggtagacgaggacgccattttgattctcaaccttgtcttatctattgccttgtgcgccgaggaggcctcgaagtcctttgcggcgggtgcactctacaatagctatcgcgatcttgttgttgcgaggcaatcaacgcccgctgtcaacgttcggcatgtcatcatcgccatactggaggtttgccccccttgttcccctttcctatgcaagtctattatcctgacatctgcattcatcacagggcttcttccatttctacatgtgtagcccccgtttggcttggcgaatgattggactggctggccgcatcgccatggaaatggggttccatagtctggacgtttgcaaagagtatatccagactgatcgacaacgcgccgaggtggccatcatctcctgtaccatagtcattttggaccggcagtggagcgcggccacgggcttgcgaccaaactttcaaacctcggatttcgagatggcgcaggcatctctggtaggaacagaccccagacgctctctccgcggacttgatcgacccttggccaggtggactaactcatctttacaacaggtcgatacgccctatttgaaggccatgatggcattcacactcgtaagcgacaatttcaacgagcccatcgcccgagccgcccgaggaaacatgtatgtggatgacgatggcctcgaggtcgctgcattccagatcaagcagtggcggaagcgagctctggagaatcataacttcatccacccaaacgaatggtccgattccacccccaagcctccagcttggaccctggtcctttatcttcgatctattgctgtccaaggcatcttactccgttcatttttccttgccaacccagacgtaaccgacatgaagaagatcaagattggcttgaagcttgtatcagactcaattggagtcctctccatcctggataagacaacgaatatatacaggctgcagcatccacattttcaacactttttgtcgacctcgtgcgccctgttgttcctcatcgtagcatatacagaacacaaaagagcaacgtcgtcaccggaattcccgaacgactatgcagaaacggtcggctcaaatttcgaggctgcactcaagctctcggccgcctacagaagaacattccggcagtcgcacaagctttggaagcgcatcatcgctatgaaagaacctctgattcgcctgggcattctacctaatgaagcccgatgtgaaggaaaagctgcattcagcgggccagtagctgttactgaggtcccaatagaccagaggagccagagcagcgagatgtctttaaaaccatccaacacgggctcatcgtccatgttagacccagtcatcacagacgaggattgggtagaattcgacatgcagtgtgggcctcaacgtagtaacttgatgggtgcattgcccgctgccattgccgacagcgactccaccatggatgtgcttgatccgctgttcctggactggcccatgtacgcggcacctacgcagaggttcttttcggagagcacgttctaagactacgctcgagcacgccttggtatcaatactactacatcgcaacaatcactacaactatcaagagaccaacagaacttgtccatcacacaacagtaatacaaacaagtgggtgtgatccatgagacgagaaacactggtttactagccaggcttagtgcccatgcgggaaacaacaatacatctacataggtagtatagccgcagttggtatctacgacgaaggaaaaattaccccgatcgtaattacaaatcacagtctgcatgcatatcacccaaactgcgggtcgattggaactcgctgtcatttcggggacctcgggagggagtcggggctagttccgagtacgtaggaagcacagagaagatagagacagtgtccgtatccatgatgggagtggtttcatactgtactatattgatcagtcccgctgtgtccctacccgatgtcaacgaaggcaccgtcctcagttatgagctaaactcggataatgtacactaagtaatatgttcagaacgactgtaaatactcaagccaacgcgtcggctaacgctttagccaacagccaaatacacgacacgtagcaaggagagcgtacaccatgataggcaagaggacctacaatcaacaggagctggacgcttatttctcccgtattgcgcttccagccaagcaccaaaaacaagatgtgtctgcgtggacgcctcaggagcagttacaatacctgggcctacttcaaaagcatcagctcatgaccgttccgtttgaaaatctcgatcttcattattcatggaaccgcgttattcacctgggtgcagatcacctcttccggaaaatcgtgctgagtccgggacggggaggctactgcatggagaacaattcgctctttcactttgtgcttttgtctctagggttcaaagcctacatggtcagcgcgcgagtatacgatatcgccaaatcatcgtacggaggctttacacactgtctaaacattgtcagaatcggtggcttgagttacggcgtcgatgtctgctttggatcgaatgtgcctgtgcatccattcaaactaacggaaggcttggtgcagcagcatctaccaccagctcaactcagattacggtacgactcgctgcctgatgggctttcagggcagaaactatggatatacgagcaaaggatcaccgataaatcgacttggtcaccattctactgctttgccgattttgaaatcttgcctcctgacttggcggtgatgaatttatggccgtctaagcaaccctcaagcttcttcacgtacaaagtgatgcttgtgcgattcacaacaggggatgagttttactacccaagccttgatgaagagctcaacactccgcctatccctggggctagagctggcgatattgacgggcagctgatactggatgggcacactatgaaatggcggaaacaaggtattaagcaatgggagattgttttgaagagcgagacggaacgaattcaggccctgaagacgtggttcaacatcagtttatgtacagatgagcagaatgcggttctgggaacagcggcagcaatatcttgatcaaaaatctgttagtcacaagctaaagttacattgctgcagcaattggctctgcttcagccattggccgtgcttgcccccttttaggcttttcaaatccattccaccttgcaaaatcatccgtatatatctcaaagcagtccagcatcctcccgacactttgcatgataatatcatctaatgagtttggccgcgtataaaatgcaggaacaggagggaaaatgatggcgcctgcacggcggagaaataacatgttatcgaggtgaatatcactcaacggcgtctctctcaccgccagcattagcttgcggttctctttgattgaaacatctgcagctcgggatataaggtcgtcgcaataccctgatcggatagccgcaagagttttcatgctgcagggcagcacggccatgccatcgtggatgaaggatccgctggctatgggggccgacatatcctttgccgtatatacgcgggaagcaagggcatgaatttcatattccgtcaaggatgtctcatactttagcgtcgctaatgcccacttgctcatgatgagatgagtctctacaccgagatcacgaagcacttttagcatatgaactgcaaatagagcgcccgtggcaccggtaatgccaataacgattcgttttgggcgacaagccttgggttctgacgttccgtatatccgattgtgtgatcgtgcgttggtctcaacttgcaagggcaatcgcacacgtccagcttgactggagctgtgagattgccgctgcgatggcgattgaaattggtcaactttccccaagactgaggcttgtgaactaaggcgcccatacaataatcttgggcaacggttgaatcgatacatgatgcggtattgaagtgatgctgaacctataattaacacacaaaaaaagacctgaggaagcttgaacttattgtcctttaggtacctaacctaggctgagtcaatagcccgaactagctgggtgaaatcgaggtgttccttcgacggaaccttctccggaaccatcgttccgaaagtgtgggactgcgtgaactctgatagtagctcaacattcgaccgaggatcactttgataaagccatgtatctacagacttgagaaaaggcatctcatcacaaggtgtcttgaaaccttagcagcacctggatataacactcttgtgaaattcacacggcaaaaccaacatggccaccttgaacaccacagacgacatcacaacagaggcccagctggacttccgcacgttcatcgaccttttacgacaagacaatgacttggtagaaatcgatcgcgagattgacccctacctcgaagtcggtgccatcgtcagacgggtcagcgagaccaatgacaaggcgcctttgtttaacaacatcaagggtgcccagaaagggctatggaggatgtttgggaacgccgcaagccttagacgggatgaaaaggaaaaatacggaagggttgcccggaaccttggccttcctagcgactcaagctggtccgacatctgcgtcagaattcaagcaggcaagcgagccacgccacttgcacctaacgtcttgtcaaccgggccttgcaaggaaaataaaatatttggtgatgagattgacctgaacaaattgcctgtgccaatgcttcacatggaagacggtggaaagtatcttcagacatacggcatccatgtcctgcgtacccctgacggctcatggaccaattggtcgattttccgcggcatggttcacgataagaaccaccttgtcgctcaggtgaatcctcgccagcacaactatgttgtaagagagaagtggagagaggctggccattcagaggtcccatgggcgttggcgctcggcgtgccaccggcagcgacaatggcagccgccatgcccattccggagggagtgtccgaaggcgaatacgttggatcaatcgttggaaagcccttggacctcgtcaaatgtgaattgagcgatctgctggttcctgccaacagtgaaatcatcctagagggcaccacgtcactgacagaaactgcctacgagggtccgtttggagattatctgggctacgtctttgacgatgatcgtcgtctcatgccgctattcaaaatcaacgcgattacatatcgtaacgatgccattttacctgtttctgtgcctggtagaattactgacgagtctgtaagtacctcaccaggcccctcattgtgtttcctttcatcttgttcttagcaaaaggctgattatggatcctgaagcacaccactgcagcgatggctgcttccgaagtactcgaattctgcaagaagcatgggttgccaatcaaggattcctatgcgcccctcgagacccatgccacttggtgtgccctgcaggttgacacggatgagctacgtaaactgcagaccaactctagagacttctgtatgaagcttggagagctcttgtttcacaacaagtcttcaatgctcatcaataggttcttggttgttggggatgacatcaatatttacgatttcaaggacttgatatgggcgttcgtcacacgctgtcgtcctgggaatgatgaatatttgtttgatgatgtgcctgggttccctcttacaccttacatgtctcacggtaccggcagcaagacacgtggtggcaagttggtatcggattgcctattccgcatggagtacacagatgcgaatagtttccgaccagtcaactttgatacttcgtatccaagctctgtgaagacaaagattgagtctatgtggaaagagcttgggtttttgggccaagattgaaagacacgcgcaacctagataagcctcggaaatgatagggaatgaacactcggagaacaaattcaatttgtgcattgtaaggatccagccttctgtgagctacccagatcgcaccctagacgagcatgattagcgtagcaaagataagacaataacgttccggaaccggtattctaggaatgatgcaggacgaaaagcatgctaaccatatcggagcatctcatttatcccctatctctcttgatatcggggatacacccggtgtcacgatggaaatttatttgagcaaaaatatatagctttcccccccaagtctcggctccctcgacacaaaagacgtattcaaaatcgcccaccacacaccaagtgcatacacttagggaaactctgaacatcaatctgaaagcaatacatttggaaatggctagcaccctccagtcgaaaattgacaaggctgctgttcacttcaagatgagagatgaatcagttgtgccgattgacaaaatttccgttgatgatttgcatcacgtcacgtctattgcgaatggacaaggagaacagtgagacagcccctgtccttagaaccttacctcctaatcataacttaacatgtggaactgctagggcctttatcgcagatgcgacttctgattcaaaattgaggttaaagattgacttgtatattctgccaatggtcaccatcatctattgtttgtcacaccgtcacccactcgctaatggacgtatgggcttccgtactaataataaatttcgacacagtgctctgctttattgaccgtgcaaacattggtgagccttttcgttatcggatttctcgagttgaagcaagcttacattctcataggcaacgcgagaattgctggtctggaggcagacctcaatatgaaagggtacgattttaacatttgtctgtcagttttctacatctcgtacatcatttttgagattccaggcaacattctctgcaagattatgggtccaggctggtttatcccagcttgttgcttgggctttggcatatgcacgatttgcaccgcttttgttcaaagctttgctgctttatgtggcctccgctttgtattgggcatttttgaggctgcaatgttgccagccacggtctattacttgtcgaggtggtacaagcgggacgagctcacgttccgactctcttttttcatcatctccgcctcattatctggtgctttcggtggtcttctcgcttcagcgatattatccatcggtcgaataggtagcatcacttcgtggaagatgatattcgctatagaaggtcagtcattctttctttaagcatcgatgccacgcctatatagtattctaacatttgttcgcaaggcattgtcacagttggattcgggttactcggcttcgctgtcatgacggatcgagcagagactgctatctggctctcgaacgcggaaaaggagcaaatatcggctcgcatcaaggcggagcgcattggcacaaccgaggttctagacaagtttgacaggaagaagttcaaacgcggcatctttaacccagtcgtgctggccacctccatgacgctttgcttcaataacatcacggtccatggcttgtcatttttcttgccgaccattgtgaaaacaatctttccagacaggactgttagagatcaacaactcttgacggttcccccctatgccttgggaacaattacttgtctcataatctgctatctgagctggaaaatggacaggcggactatttttctcatcctttgcccgcctttttccatcattggctacagcatgttcctggcttcgacaaccgctcatgtcagatatggagccacattccttcctgttgtaggcatatttgctgtcggggcactcaccaattcccatgtctcggcaaacgtggtctctgacactgccaggtcgtctgctgtggctaccaacgctatgtttggtaacatcggtggactggtctcgacttgggccttcttgccgttcgatgggcccctttacccaattggaaatgctttgaatctgggtgttcaaagtggcattttcgcagttgccctgggcatgtacttctggatcaatcgcaacaacaaagccagggctcagagggatgccgaggctgaactggccggtaagaccttgctggaaattcaggatcttgactggaaacaccctggtttccgatggcacaactgaaacttagaaactatggacgcgtcctagcagtactgtcaatgtggctctcggttagatgaagggtgactctccgacgcatgatagatttatctgtcaatttgaatcgctacctacaacgggcttcacattggctgcttagtgtagactgaaccctccaagtagctagagtgagtgctgggttgcctcgtcgcgaagatatacaatattgttaatgtacctattcgctaaattgtgatgagtacgcgctatgacctgtaccagagaactgcctcctgacgtacttcaagttcaaatatgactacttaagtgcacgggattctacatatccaatcacccgtatcttttaggcatgacagtctaacctgtgacggatgtttacattgcgatatcctgatctcattcgaatgggaaaagaaaaacaatcacatttcatagtcaagatctccataagtcgaccttatcttgtagggtagcatggcaaattgtcacagtatccaaaattatcctccttgcgtaaagtggcactggactcacacatgggtttgaagctaagtcggggaaccatcggaagcgttacccacattatacggaggccggttgacatccgcagttcctacgattctaggccagatagttccattccggttccgaatgcggctaatgaggagctacggaaggaacttatcttctaatcataagcggctatccgcaatggaagtcccgaagagtatcaaattacacgatagccttatcttaatgtctcctagtttagatggcaagagagggttagcaaaattttaattaaatactcaaaagccacacgacatcatcactgcagtattaagacaaatattgatcaaaactgttcgagcgcttggaagatgcaagaagagttggatctcgtcgtagttggcgcaggtaggtcccaccaatcttcttctttttggtgcctactgttacttgcaaggactaatatagatttaggctggttcggtctggccgccgcaaagacttacattgaactccaccccaatgagaagatagtggtcattgaaggagacaatagcattggggggacctggtctgagggacgtctctatcctggtttgaaatcgaataacctatgcggatcgtatgaatatccagatttcccaatggaagagagtgtctacggtgtcagagccggccaagatcatattcccgcggcgactctacatcgttacctgacagacttctccaagaaatttggagtgtacgagcggacacgtctcaataccaaagttaatactatacggccaagcgatggcggcggctggcaattaagcataacctccaaagaaggccaataccaactacaaacgaagaagctgattctcgccactggtttgacctcgacgccaaatattcccagctacccaggccaggaacacttcacgccaccttttttccatgctaaagacttctgtaccaatggcgagttggtggacacggctcagaatgccgtagttgtcggcggtggaaagtctgcgtatgactgcgcctatgcatttgcagagaaaggcgcacaggtggacttggttgttcgaccaacaggccaggggccagtatggctgtgtcctccctttgtaaccccattcaaacgaatgatggaagagttgcttaacacgagagccctcacatggttcagcccttgcccttggggaggcgaagatggttattctgtcgcacgagacttccttcacggcacagccttgggcaggttgttggtagacaactactggaatcaattgaccaatgaggttattgaaacacatgggtttgatgatcacccagaaaccttcaagttgaagccttggtactcggccatgtggacaggcagtggcgtggggattcacaacttctccagcaatttctatgagatggtgcgaaacgggaaaatcagggttcacctcgctgagatcacaaagctcgatggggactcggtgactctgagcactggacagaccgttcgtaccgatgtggtcgtatgtgccaccggctggaagaaggagtcgactatcagctttgaaaatttgggtaaaggcggcatgggcgtagcccgcagtcacgaagagattgaacgcttgagtagcaacgctgacaaggagattttggcccgatttccccgcctcaagtttcagccagttctcaggtatgaacagacgaaggagaccccactgcgaaactaccgcttcattgtcccagcgtccctggtcttccagcgcaacatagcatatgctggtatggtgtcaaccgtcagtactgctgcatttgccaacgctcaagctctttggatctcagcattcttcgatgggaaactcaagaggacgccaagagatgatgacgaggtcacaaaggaggttatgctccacacccaatttggtaaatggagatatccttgcggttatggagccaacctccctgattttgcttttgatgccctaccgtatattgatctactcctcaacgacattggcgtgaagaaccatcgtaaggctacacaaattgccgaattcactgaggcgtataagccaaaagactacaaaggtttaactgaagaatttcttgagttgcatggagggaagttgccagcggctacgaatggcttctagagttagatgaactaaattgaatttttcctctgtgaataacagatcacttgtttcttgcagaccagcaacggtcaggattatcagaactgtagtcgtcaacctacatccttctaaggggggtattaggaaagggccttttgacaaaagcgcgtggaccaaagtagtgcttccgaagactgctgtattaaaatgtcatgcttttcaaactgtgttgatgtagcaaacccctactagatacgatcactctgtggtacctaggtaggacaagataaatgtctgtgtgttctgccagatgattttatctcctatcatctgacttaagggtacagatcggcaacggctcgcgttcatatatatcagacttagggtataagtggcagaaaaaaggccacgggctttcaactatcgatgtaaccagagctaagaggaatccttcaatctatactaaacgacttaactctctacttattattagtcctaacctttacattttagccttaacaacagagttattgaccttctggtgagtagcaatgatcttcttgtagttggggaaaagctctttagggtcccatcgttgtcgaatcttcaagaacttctccaatgcaatatctgacatgactttcccctatatgacgtgagttagtggtcgcttcaataattgacagggatgtgtgcgacatacgttggagtcatcgcaggtaacatcataatcagccacgtaaataccacaggcggctggaagagcctgcttgtaccggtccctcatatgttggtagatatcaggctccaaacccgggtccttccactgcgtgatggtggaaatatagtactgctgcggcatgctgaggagtgcgtcgccgtcctcgtctggtttgatgtcgcagatgcacatgaatgctgacgacagacgcgtagggagctcgcaaagggcaggcttaacagccttgataagctgaaaattcattgtcagagctaccattgactcatcaacgtggctgtgttcaacatacctgtggtagtggcaacgagggctcgttgagcatgctgaggatagaccaccgctggccagcacttccaatgagtcccctctttttcttgtaaatatgctcaaaggacgatgcctgaagtggtttcacttcaaccaataggtccttgattgaaggaggaatgtcgtcataggcactgagtaaaatggaagcttgtgccttggtgtcagcgtaggcctgcaagctcaagcccatgtgaagctttgcattggccgggatctcgtcggtgtccaaagtgggatcatatttctctggatagaatattgtcatgttgagatccgttccccattgaggagttttgtttcctgactcaaacgcccaagtcatgagctcctcgtacttgtcaccgagttcgaaagtcaaagatcggtcccaaagattggatgctcgcatcgttcgggcccaaaacttcgtgactactccgaagaatgcaagcccgcttcctcttgccgcccagaacaagtcgcgattctcagttcgactggcagtaacaacccgaccatcaggaacaactatctccattttggtgatccaagtctgggaagttgcaccccaccctcggacaaaccagccttgtccaccagcgagcaggaatccacccgctgcaacggttggtgcatggccgtgtgggaagaatctcttgacggaggccagctttgcggagatttcctcaaccctgacagctggtccaaaatgaatctcttgtgtaattcggtcgtatacagcttccctgttgagattggtcgtgtctatcatgataccattatcaacaatagcaccgagagaaaaaatatgaccggacgaccggactccgatactgactccaagctcagaagctctcttgatagccttggaaacatcttcagtagtttcaactacgtgaatttcgtgcgggtagcgctctggggtggctgcgcttggattgtttgaccgacaacgttcatagtcgtcagtacctcgttggagaattttggcagagtattttccttttgtggtatacatggttgttttggggttcaaagtaatgctgcctttgagagcttcgtagtaacaatagtttcgaaatcaaaaaacaactagctttgtgaatataatttcaaccttacgtcgtgaggttgcttactgttaccagtcagcagcattacggatactaccgtggattacggttcaaccagatccacttcataatttagattgcttgcccctacaaatcgctattccggaattccggaattccgtacaggtttgggggaacaccagctctccggaagctaggatcggaatgacaactcacaatgatttggtttcgggagataccgaactttatggtattttgcagttttagtagtccgggatatgcccagagtcggttgcttaaagcggtgtcactaagcgagaataggagcagttacagtcccaaaggcaaagcaacggacaaaagctcaatcacatcaaccatgtctacaacgtgagtacacctgtgtttcaaaagatatcactaactgacacggacaggatggaaaaatactctgcttcaagtgcattcttcgagtcccttgcagaggttagttcctcaaggtgtccacccatgcatctcgtatggttacatatgactgacagcaaataggcgggaataagctatgtctttgtcaatcttggatctgaccatcctgccatcatggaggcattggcaaaggataggaaaggaacaaaatttcccaaaattataacctgtcctcacgaggcaagcactctaccgcacttgatgccagatttgtagtactaactcgtgatacagtatgttgcaatgtcaatggccgacggttttgctcgtttgacaggtaaacctcagtgtgtcttggtgcacgtcgatgtgggcacgcaaatgctcgggtgtgctatgcataatgcatctatagcccgctgcccagttcttgtattcgctggcctatctcctttcaccattgaaggagaaatgcgcggttctcgcacagaatacatacattggctccaagatgtgcccgatcagaagcaaatcgtggcgcagtattgcaggtatactggtgaattcaagaccggaaagaacatcaagcaaatagtcaatcgggcgctccaacttgccaacagtggtgccaaaggccctgcatacttggtcggtgcccgcgaagtgatggaagaagaaatcacgccctactatcttgatcaaacgctctgggaacccgtggctcctataggtcttcctcaagagggcccagaaagtatcgtgtctacgctttctaaagctgagaagccgctcataatagtcgggtactcgggccgcaaccatgccacagtgccccagctagtaaagcttgttgaatcaattcctggagttagagttctagatgctctgggtagcgatgtgtgtttccctttctcccaccgagcatatttgggagtacggattggaaagcacgaggcaatccgcgatgcagatgctattgtgattttggattgcgatgtcccatggattcccacccaatgtcaaacaagaccagactgcaggattatccaaatcgacgtcgaccccttgaagcaaaatattccagtccactatgtgcctgctttccgcaggtatcaggcagactctgagacagctctccagcagatcaacgactatatcgcttcccacccagatcactctcgtctttcacagcttgagccatgggtgtcccgttgggaagctctaggacaggactgtcgacagcgattagagcaagtgacgaagcttgcggctcccccttcaggaggaaaccatctgccaccatctacttcctatctctgttcacagctcagacagtcatgcccagcagacactatttggtgcatagaagctgtgacaaacgccatgtacgtctatgaccagctacaggtcgataagcctggtcatatcgtcaacggcgggggcggcggtctaggctggtctggaggtggtaccattggtgttaagcttgccacagattggctttctggggggacgggcaagggtaagtttgtttgcgagattgtcggagacggtacctacatgttcggagttccgtcgacggtttactggattgcccggaggtactcgcttccaacattaacagttgttttaagcaataaaggtatgagtgtcctcatttgaccgcaatgtagtgcatcggctgaccaaattacgcaggatggaatgctcccaggaactcgatggaactggtgcaccctaacggatatggatccaaaatctcgaatgaggagctgaatatttccttctcgcccacaccagacttttcaggtattgctaaagcagcagctggaggaaatgcttgggcaggtgtggtggagagcgcggatgatgtccagaggctactcccggaagctattgccgcggtgaggagtgggatatctgctattatggaggtgcgccttgcaggctcttggggtgcgggtaaattgtagacgtgcaacttgagaagaaaaaaaccgaaccattctatcctaaaattctaccatttacttcctcggcaattatgtatctccacatgtttgtttaccttgcttacgggagagagttcgagtgtaaagtcaaaaccaacaatagaagatgccagacccaacatctcaacacaattaatagtttacgttgcttagacctacctaaggcaggactaaatacgcagccatgataacgacttcctgaataggagctgaatggaggtaggtaagagtacaggaaagcagcggcaaattcatcaattgtatagaactacctctgcactgattttctatccacggagactagaatcgaatgctttgtcggccataacgcagcacaacaataaccctaagttccaatccgcccgacgtgcaagcctccagtgatggcaatgtcagttcctgtggtgtagctggatgcatcactcaacagataaatgatggcaccaacaagatcatcacatgtcccaattcgttggagcggcggcgtcttgaccattatgagatccatctccggattctgctttcgaacttgctgcgtcatctccgtgtctatgaagccaggcgagatgctgttggtgcggatctggtggggtgcgagctcaacagcaagggactcagatagaaccttgacagcaccctttgtcgcgccatatgcagacattctatgatggggcaaaaccgtataggacgtgatggaggcgatcaaaacgatgctaccacccttgctcttttgcttcttcatttgagccgtagcaagttgagcagtaaggtatgtccccacgaccttcatgtttccattagttgcttgaaggtaggagaatcacaagatgtatttcttacattcacgtcttgaagccttttcgtttcttgaaaagttgtttcttcaaacgctttctccagtgcaatgcctgcacaagtgacacacccatcgaggctccccaaaacgtcaacagccagtttgaaagccgatttcaggctcgcctcatcggtcacgtctccctgaaaatacttggccttcacggagaattgctccgcaatggcatcgtagtcttggccaggtttgttcttgatatcgatccccaccacgttggcgccagcctgggccagagcattcacaacagagaatcctatgccctgcgctcccccggtcacaatgaaattgcgattactaatgtcaaatcgattggagttgcccatatttctgttgtgcaacgatgttttttggtatgaggctagtatgttattagacagacggcattggccaaggagttgaagacatttgcagacgtcaaaataatagaagtatcgctgtgattgtcaaccaggcccatgggacacttcttgaagacggtaatgtcggaaacctacggttcggggaataaacctacattgcatgggagagtgctattggcaaagctgagtggagatggagcctaccaatgcttacggaagttcggaattcgacactatcattagtttccggaacacatagaaatggctgaaccttgttgagtagtattgcacatggctttagcggacgactacttgtgctaactctgacaatctttgatcgtgcgcccagtgctgctaggttctccaagcgatagatgagacggggatagatcgggaggctcctcgtcacttccacaatgcctagaaacccgagatcggcttcggccgttactattttcagattcgaatccttttaatggcctcaattcaaatcgtaaaaacggccttgatgcttgacaatcctagtttggacaacaacatctcgagtaaacagtgccgttacgaaacttcaagtacccagtcaacaatcttgagaaatggctaccacacaaggatggaggcagcttgacattgccatcattgggggaggtattggtggccaagctagcgcgacatcattgcgtcgacagggccacaaagtgaccatttacgagagagcggactttgctggtgaagttggtgcttccatctcgtgcgctgccaacgggacaagatttctagaggattggaaagtgaacattgagcttggtgaccccgtcatactgaaaaaactcatcagccgtgactggaagacgggtgagcctgtcagtgtgtatgacttggctgactacaaggagcggtggggatatgtaagtgctccactcggatgtcaagatttggatcttcacgtaacattttcaattgaattgcagacgtattacatgttccatcggcagtacatgcacaccatgctaatggacagtgccctctcggaaagtggtgacggaattccagcaaagttaattgtcaatcacaaggtgggcctcttgagtgggcttgttctatgacctcaacttacattctttccaggctgaaaccgttgaccctgaaactggggaaatcaccttctccaacgggaacaaggcaaagcacgatgtcgtcattggagccgacggaatcggctcagccgtccgcaaatctctgggcattgaagtctccaggactcctgccacttgcacctgtctacacgccaacgtagacacggagaaagcagtaaagctcggcctgattgattactctcagaattcagccattgagtattggggtggctatcacacgcactacaagattgtcttgtccccgtgcaatggtggtaagcttctgtcatactactgcttctttcctcgagaggctggcgacgtccgcgctcagaagtgggatgaggcatccaccgtggaagagctcctagccccataccccgaccttgatcgaaatgtgttcaagcatcttgcacttgggtacgaggtacgaccctggcgcttgtggcttcacgagccctatcccctctggcaaaagggtgttacatgcattattggcgatgcagctcatccagtaagtcgacgaccggcagttagaagccttcctactgacagattcagatgatgccggatcaaagccagggcgcatgccaggcgatagaggattctggcgctcttggtctcgttttcagcaaacaaaacttcaatggagatatcaagcaagcattggaggtcttcgaagaagtacgcaagccacggggaacaaaggttcaagctgcatcggcaagggctcgtgaaaatatcaacgagagaattggtaagattggatgatttatcaaaactccaattggctgaccgtatctaggcttctcgagcaataccgacaatgaggtgtattcagttgcaaacgaagagggcaagctgaccattgatgaaatgaacaggcatgtcctaaatctcgccgaattatcagataacaactaataatctttgtttcaggtacgatatgaaggctcacattcgagaggtgctgttgaggcgaagggaacaagtgtcggagcctaccaatggcaaagcgtaaactcggaattgcaaccagttcgggcaagaaattcaaatcctgtcacatacacttgtctctacaatatagccagaactccaggttaaatttcgcgacggcttggaatataaatcaaaggcaattctatctgctctaaatttgggtggaaaacatctgtggacttgagtcaaataccaacaatcacttactaagcattaagtagttgttgtgccttgtatgttccatttaattcagtgattcaattaccgaccgaagcacccttcgcacgcctctaggtgtattgatttttgatcagatacttctccaatgagatgaaagcttgggtcccagcaccgccgctctaattgaagatatttggagtgcatttgcaggtggtcaagttagtatgccctgacattagctaccctagatgccagtctgggccctggtccgtcatctgttcatttgctgttgttttttgttgtaattaaaaaagggatgtatcaggccacgtgattttgtttcattattttttataccaaataaagtctacccgaaccttcatgaatatttgagacctaccctatagtctcaacctctctgctcccatacaggaaaaatgagagattggttaagatgagttcaatatttgagatgcaatatattttcttaattcaagctaacagagcccttttctttcatcttagatgaactttgaatgtataaaatttcccaactagaagaaagtgtcagtatatgaaattgtcgtattttcaaagcaaagagatttctgcttagaaagcggactcgccaccccggtagataaaatacttgtatcttattggttcaaacaagggtactgtgggcgtctttacatgtttaactacaattaggatagcgcttcctaatatgacggtggccgcggggagatgctccacttgccggggaaacgactcacaatcggggaaacgtcccgacacatgcggaatcttaccggtttcctccaaatacgctaaactcgtttcactcagcagtagggaactatggtgttgaggatgtttataaggtggcatccaaataatcaacgactggagccaaacactattacatcgcgtcatccttgaaaaggcagaaagaaagaaaattgattgatcatttgagaaaaagcacactacgtgaactgggctgaacagcacaacgtcgcaatgggtggtcttcttaatggcaatcacaccaagacccatttcggaaccaatcttcctctcattgttgatggtaaagatgttacaacagggaacgtcatttctgtcattagccctctgaccgataaagaggtgtggacagcatctgctgcatctacaaaggaagcccttgatgcggtgacggcggctgaaaaggcattcccagcgtggtctaaaacaaaaccctctgagagacgtgaccttttcttgcgcgcagcagaactgttcttggagagaaaaaaagagctgcagacaatcattcatcatgaaattggggccgatgagcattatcaagagttcatcattggcctagctgtcgaaggactgaaagacaccgctggcagaatagcgagcgcggtcgaaggccacgttccagcttctattcatgatggcatgagggctttgatccagaaaaaaccatatggtgtcatcttggggatcgctccttggtaagtttcaggccagcacaaccatctgttatccactaatatttggtcaggaatgcgccgtatcatcttggtttaaggtccatcagcttcgctcttgcagctggcaacacgacagttctcaagggttccgagctctctcccctctgttactgggccattgccgatatctttcgccaagctgggttaccagatgggtgtttaaatttgatccttcaccggccgcaagacgcggcggaggttacgagcgcgctgattgccgaccctcgcatcagaaaagtcaacttcaccggaagctcaggcgtaggcagcatcattgcaagcctttgtggtcagcacctcaagccagttcttctggagctcggtggaaaggcaagcgccatagttatgggcgatgcggacctggaaaatgccgcaaagcattgcgctctcggagctttcatgaatgtgagatacagccctctgatttcgttcctaaaccagttgatcaaagcgtgcttgctgatgttggtctaggcgggtcaaatatgcatgtcgacggaacgagttgtggtacatgcatcagttgcctccaagttccagcagctctttaccgaagctgttgacagacacttttcttcggctaacaataagccagctctgataacatctgcttctgccaagagaaacaaggaccttgtgcaagatgcactctcaaagggcgcgcagctgctgcatggagacaaagggtcgacttctgcagaaggtgatgtagcaacgaaaatgtcagcaacaattcttagtggcatcaacgaggacatgaagctgtacgcaacggagtcgttcggtcctagtacttcattatttgtctatgattccgaggaagaggctttacgtttggtaaatgataccgagtatgggctgtcggcagcaatcttcaccaatgatctcgggaaagcttttcgatttgctgatggcctggagtctggcgctgtacatatcaattccatgactgtacacgatgaatttgctcttcctcatgggggagtcaaaaagagtggctatgggcggttcaatggttcccaaggcttagatgagtttttgtactacaagtcagtgacctggatggtataattcattgaagctcgaaagcactcagcaatgaaaaaatattggatcgaaaatatgatagattagaaccttgtgtgattggatgcttcaagtaaaatataccaagttgataattgaacaattcttctttgagattatcttgtatcgcgtcttttttgctagatggcttatatctcagctcagagggctattgattgccattcaattatgaggcctctttccaaataataaggacagctcactcttggcagcgtgcttaacccccccttggccacattcgacggcatacctgaagcttcgctcaaacccaacagccgaggccccacgacaaatagctctaagcacattggaacctctgcagaagccaccatcaatcagaatatgcatggtagtacatacctctggacaattggtattgttatactcctctgatgtatcccggcccgcaaagcgatatattactgaggatttgcatcaggctttgattctgttcaaaacccacaatggcttttgtgacagttgccggcttgtggcccccctagaatggctgggagtaaaggcagtaatatcatatgtatcattaccaaaaagtatttacacattatcaaggttgacatgttgactaatctcagacatggaggctgggcggacgttctaccaactgctgcatagacgatatcggcatgatttagggcgatacaaggacggcgattagggcgtctcactatcaaagggaattgaatcttgaattaggacccctttctattcgccggcgtatagcctgcgaaccaggaacgttccgaacggctttccgtgcctatctccaagacaagtcccacaagaccccgtagtctagatcgttcgccactgataagcatcctggtatttcgacggcttgcgctacccgaaacgcggggaaagtgccgctggagatgtgccatctccctgcctttgattgggttgttgtgacccgccttgcatagaccaaactcaatacatacaaagcctggccttccctcttgtttcggacggctgtctcgaagagaattgccatcgtcattgagatcttgaggcgacgcatcctatccacacatctcaattctctttgtcccagcttgatcacttcgaatttcgagcctaagattgatgagattcctcaagagtaagtccacagtgttcggccgataattgtgaaatctggctaacgttctcgtctcttgcagtggcctctaaaaaaccaaccgccgtgtcgattgaagaccttgccatcgtccccacgaacgctcagtcgattgtggaggtaggctattgccacctatatcttctcggagacttttagttaatactgcaaatagacgtacaagaacttcaacacgctctccatactttccctcgccgtgtcccttatggcaacatgggaaggactcctgagcacatttggtcagggcctcaatgcagccggtcctgtgtcattggtctatgggttcatcggtacggtctatttggtcaccttgatcaagtttgagagggcatatgctaacagtgtttttttttagttgcattcatcggcagcactgcgaccgccgcgtccctatctgaaccagcgtcgaggtttgttgtagatttcaaacgcccgaggattgatccagctcataatgatttccaaggtatcctacggccggcggccagtaccacttcatggccatgctgagctccgacaagcatcggccttggctcagttggtatgcgggctggctcacgattctcggttggctcgccttgactgctagtgccccttttgctgggggaaccctgatccagggcctcgtcacgctcaactatccggattacgtccctgagagatggcatggcaccttgctctacctcgccattcttgctattgcctttgccctcaacttatggggaagcaagctgcttccactgatagagaacttgatcatggctctgcatatactctttttctttgccatactcatcgccgttgcggtgcttccccgcaataggaactctgcgagctttgtgttcacaaattttcaaaataatacaggctgggagagtgacggaatagcatggtgtataggacttctgacatccgcctacattaccgtcggttagtcggctacacccttcctggagcttaggattacttgactggctgactctggcttcttgatcaggttatgactctgcgactcacatgtgtgaagagatgaagaaccctacaatgggggtaccgcgtgccatgatagggtccctcctcatcaactgcaccatgggatttgctgtgctaattgctgtcctctttggtattggagacatcaatgaggcgcttgcatctccaactggattccccattatcaccgtgttcacggaaatgacgcgtggaaatacgtcagcgagctcagccatggtctgcaccattattatatccgcgtctttggctactgtcggactgatcgcttcgacatctcgatcattgtgggcatttgctcgtgatgatgctccgccgtttagcccttggctcgccagacttgataagaagcgccacactccttctaacgcagtgatttgttgttccgttttcctggctctcttgggcttactcaacattgcatctacgactgcattcactgccattctgtcgcttaccgtggttagcctgagcttgtcctatgtactgccgattattgctatgctctatcgtcgagtcgcaaacgtcgagaagatttcctttgggccttggcgaatgtcgcctgttctgggcactgttttaaatattgttgcaatttcttacaacatcttcctctgtatcttccttctgctgcctcctattcaaccagtcacggctcagaatatgaattatgctagtgctgtccttggaggggtcttggtttttatcaccgtcgactggttcattcgaggacgaaaggtgtatagtggacctcagtatctctaaatctcagcgcgctcctggatgttgaaggccatatttaacattgacgagatcaacaaatcactgtacttcttgctcaagttgggaagtgtttgtttcaattggacagtcatgttgataacgccttgcacatcattctgatgatctgagctatgaacattgagctaggccgagaaactttatacttatagaatatctgctgaccatgcattgtcgtcgaaccatcgttgaaagtcattactcagagaaggatcgaattccaggttctgaattaagccgatactgttatcaagtgctattccctccaatggtaaatcggtattaatcttgccgacaagtgcattcttatttattaggatatgaggttgagatgctgatagatttgcataggtggtggctgttgcagacggcgtagctagaactggaatgatggccgttagcaaccgaacgacaatgaaataaaatccatttagaagctaagcttaccccattccttaaccactcgttgtagatcttggaggtacctgatacatcggctgaggagttgattgtcttggtccagctgcaagagtgcttcgatagcttgtcccaagatatgctgccccatctccaattgactgacgctatctaagctgacattattgtcggctttgggcacgaacaagctcccaaaaactaataaacttgcgttgaagactgcgaatggaggttagttgcaccgattgacaaggaagggtttttgtagttctaaccgtagtagagagtaaaccaccaggcgcctaggaaatgctttccaaggtccggccgagtcaatacgctgtggacaatatatattattttccgagcatagtctgtgcaactgtcactgagatttagttgcatttggctaatggactgctgtgactgggacgagtcaaagtctgtgctgagtagtttggtgagaacaggccggtatagcaaaagctgggcatggaggtatctcattgtcagcacgaatctgtatctctctccaatgggattactgctatcgacatttaacatgttttctggcgtgactagactcaagccgggacctagtgagtcttgccactcattcagctcatgctgaatgagaaagatctgtgtgatcatgttggtgtcagatgtctcctcgcatcccaggttatgcccataaaggctgcccatgatgtgccataaaattttgtagagtgagctaacttcattagttcaatttttgtaatgagacactcgctttggttctactcacacagtcccagcgaagaacgatatcccagtacgatcaatgtgatcaccttgcacaagccgtggaacgtccaggcgcacataatcatccggtatcgcacttggacgcccaaatgtcatgctaagatgtctagaagatggtcaacatgctctgaattgccacggggggtagctgggttacctgtcaagaagaacacagctgagccatgtccgtttccccatctcctgctcaacgtctggcaatctgcgcaatgcttctttggaatggatccctattgacatggctgctttgactgccaaaccgtgtacggcccaggtttggacggactgttgagttccctggaggtactggctcgtcaagaggagaaattgcacttgcgtggacaatgttaggaatgaattggtcgaagtttgaaagatcccgttccttaccggtctctaaactagttccgcgctgcatcggctttccacaaagctcttgggcgcgttgatagaagatggcagattcaaaatgcgaagtcgtcctagtagtgctttgccgcccgctctcactccaagctgccatcgcgagtaccatgtttaagagtcccaggaatgttcggcgcacgttgccacggaagttttgctcgcgaatgtgactataagtctcgacaaacgaaggtttatggatgtacggaaataacatgccggtatttgagaagtatcggttgactaactgctctgtttgctcatgagagggtaggatgttgcatcctcccggatttgaagcatctccgctcgcactacacacatttggtgactcggggaatgctcgagcaagattgatagcgctggtgcgatttgcatcggccggggttttgaagcccacgatagtattgttgatattggcagcccgcttgtatgccacggcacggaaaatggtacgcattagggcgatgttcgacgtaggtcctgcagaatttagtcttggtcgatagaaggttccagcactagaagagagacgcaccaaagaagctgcagtcttcatcttttactagagacattgccatcccgtcagtcttgtcgttctgtgactgggcgtcagcctcaagaggatcttgaatgctaataacaatcatgccagggggcgcggatattgtgtgttccccgttcctttcctcactgttgacaaccgacgaaggagctatggtgccttcatctttgcttggtgagcctgtatgattagattgtctcctcaactgcctctcgaccgcctctactctggcttcaagagcagcaaagatactggtccggatttagcgattgatgctaggtgaggtagatgaagtaacccaactctggttggactcggggcacctactctttgccaataatgagattggatgatgaattgggcatctcataggtacactcgaaccccatccgctcacacagcgaacatttcgggcgctgaccattgcacttgcgacccattatctgcagtcagcacttggatctggggaccaacattatggcttatgagacacaccctcgatttgcgcgtgcgacaagcactgcacgccaaggcaatacgacgtcgcttgctattgtttggcccgctctcttcttggtgattatcctcgtgtgtgctctcaacggacggacttgcgctgctgcggcctctccacatcttcggaaatcgtcaatctgcacggttgcctgagttgagcgtgatatatccgatcgatccagattgtcgagcgcgggaggctaataatggggattacttgatgaccattcttcaaccccagactgggtggacactcatgacctggtccacatgccagaaaaaggtaacatttaattacatcttctcgggatcacttacggacttgatcttcgccctccacttcggttccccgcacatctcgttccgccaattccgacatcccaagttacactttggccactggtttgatgccccagaaatagcttatcatacgcacctgtcacatttcgacctcttatctcttgggaggagctagagcagtagtatgtaactggtagggggttggttggtgtgataacgttaggaaatcatcggttaggagatacttattcattagagatcatttcaccatgttggaagtactgctgatccgtagcctgcttcactaaacctcgccacttattataatcccatctaagattcaatcttagaaaggcttgataagtacctaacagtactcaccgtcaaatagcggggaagtgaattattgctgcttgagctgcctcaaagagatagccatcttcccgatctgtattggacgagccacgagtctgaagccgacgcgtttggcgtcacatcaagagcgcatgttatgaaatatggatttaatttatgcagatcaaggttctggaaattctatcattgctgacaattcaatgtctgaagctattgagactcttaaattcaacccatacggttatatgcaatacccgcacctgcaggtggccatcacgcgaactccaccccgttacgaagtgttccaatctcactgacattaacctccatcttggtcccagggacaagataacgcgggggcttcagtcctgcaccaactcctgcgacagtttctgttagcgtgcttgatcaagtcgtgcaaataaagcatcatgcacccgacgtacctcctggtgtaccagtcataatgatggagcctttctggagggtcgttcctgtagagagatacgagatgaggtacgggacactgaaaagcagatcgtcgagcccagaagactgtcgcaattctccgtcgacgaccgtcttcagctgcaatctagctgggtctgggataagagccgagctgaccaatactgggccaaggggcgcataagtgtcgaaaccctttgagaagccccattgtggcacagggcctgcaagtgtgctatcacgttgcagcttccggctagatatatcgttacctacggtgtacgccgcaacgtaatcgagagcatcagcctcagagacatccttggcatcctttccaagtaccacacactgtagaaatcttagtatgctgtttccaaagtttcctataacatgcacttactagctcgccttcgtagtctgcttggtcgtcctgagcaacctttggcacaacaacgtttgcgccgtggtctaaaactgcaggggaccctttgcagaacatgaatgggtatgttggtggttttcttcccgtctcacgaacttcaaatgaattcatcggtaagaacagaatgcttgtgaacaagacaaaagccagcggctgcgcaagtagaggtcggaatgaggtcaacttactgtgagttgcgtagtttagtccaatgcacctaatgattggaacctctgatggttctacaggtcctaaaagtgtctttacggtcacgacttcgtctgtcacagatgtctgcccagacgtgtcatagagatctctaccggcgataactttggcctgcagtctggtgctctcatctgtcctgccgaggtcaaagtcaggcgttgataagattggttctcctcgtaaggttcgcccatcagtggcgatgaatcggatggcgcgattccacgaaactttcatcttgtttgtagtgtagctgctgagaatactgacacagacttgtgaagagacagagcagatctcacccaagaaacctaataaggcaaaacaaaaccaaatgatccattcgagccacaaccttcacgtaccgtactttccgggggctgacaggctgattcccgatccttccccgacctgccgattcttggtggggacatgcgggtgtgtcggaaagacacccgatccgtgggagaggtcgtcacttggcatggccgggaaagccaccccatgatgcaatgctatggaggccagccatccggatcctgacaagaaacaagacttccacgagtaaaatctaatcaatcaatctataatagaaggcctttccaaaggtttcttatcattccatttatcgaatatcaaattcaaagattatcattcctgcaaaagacacttcatcatggcaactcagacgatcagcgcaagaatccagaacggaaattctcttccggagaacatagctgcaaaaggcgacaacggctctcacaagtttgagactggcgaagccttggttgaagctctgacggatgtcaacgtactccctctatgggcgcagatggcaagactcaaccctgcgcttccaaacccaactactaagcccttcatttgggagtatgagaagatccgaccatacttggtgagcgctggtgagctcatcaaggaagagcaagctgagcgacgagttcttatgctagtcaaccccgaacgaagtatgcatcaaaagacaatcgcggagacaaactcataatatactgacacgcacatagctgctccttatactaccgacacgctgtacgctggactgcaactggtcatgccacgagagacggctcccgcccatcgtcattctgcctttgctgtccgcttcattattgaagggcaaggtggtttcacggctgtgcatggtcgccgcgtcgagatgagacctcgcgatgttcttgtcacaccaacctggaactggcacgatcacggcaagaaaggggccgaagaaaagggtggtgatgactctcccgtcatctggctcgatggcctggacctgcccgagttcattcacttcccagtccatttcaatgaacactactcagcttcgcgatatccggccgagaatgttgataactcgccaattgtcttcccgtgggacaagatgcaaaagaagctcgatagccagacgtcggtatgggccaaggcacgttatttgaaatcgaatggttctgaacgtaagtcactgagggagatgaatacttccagaagtcgaagaatgcgtgcataagtactaaccttccgaagtgagcaaaactattggagcatgcgctgagcgcatcgaagctaagtctgagtcaccatcaatccgcgagacttcttcagcagtctaccatgtcattgaaggaagcggctactcacagataggggataagaaaatacactggaaggctggtgacacattctgtattccggcatggtatcgctaccaacactttgctggtaatgagaaggcttacctatatcgttttgatgatcatcctatgctcaaagcacttggattttatcgctacgaaggtcaagactctgaatcactagtttcggagtagacatggcctagtcaggggactccattccttatttttcaccaatcgtatcttattgttgagagactagccgagaacaaacatcgcattcgaataccatttagcaaatgctgatcctttagatatgacataagtgaccactttgatcaggtctgatctgagaacaggcaacgattatcatcagtcatcactctccggccgcttgctgtcgctctttgagcttcaatacaggtccatcgtgaagagacgtaaacacatcatagagttggaactcatctttcctgcctctgccatcgtttctaccgactgtaccagcgccgatctggccttgcggtccaggggcgatctctaggtcaaagtaatacaaggttttagccatggtcaggctgatttcgaggtaggccactgcctttccagcacaggatcggccacccaccccaaagggagcaaatgcgcgccgcatcaatgatgaagagtctcttccttcagctgtcagccacctttccggaatgaactgaaaagggtctgagaagtattcctcattatgatgcagagcgtatatgttaacagcaacctgactgccaccggggatgacatgcccgtcaaccacaagggggggatcttctatgctaccatcgggcagcttttttggtgggattttctcgcgccatagcatgcctggagcagggggcgacatgcgcaatgcttcatcgatgcaggctcgaaggtatacacaatctcgtagtgcctttccagaatgaatatcctcaccggattggaaatgagttcgtatctcttcattcagcttttcatagactcttgggtagcgcgtcaagtaaaagaagagcgcagccatggcggttgctgaagtggcacctccagcaacgacgaagaagaaggcttcagcccacagctcactgttgatgaggcttgtgccacctttcatgctgtccgcggcatatgcataaagatctcgcttggcatctttaggcatgctggtgcgattgactatcatcttcccaatgatgctcctgtatttgttgcgaatcttgcttcccagtatcttcagggcgggctcaatgaaggccaacttgggaaactgcatgtagatgttaacacgcacattgacgaaagacaatccccacatcaaccactgattagtttcttctgtctgcatcttgagaggatacccgaatcctagatgtcctaccacgtcccccccaaggtactcgagacgtttcgtcatattgattggctccgacagacggcatgactctcgcagctgctgaataaatgtatcgatctgttctgccattgtaggctcaaagtcccgcatggctttctctgagatgggctggctgatgatctttcgctttctacgatgctcgtcgacttcaggagtatcgaaaacatttcccaagggtgtcattcgggtcaggacataaacttcggactttgtcaccaaggggttcgcgtatatgtctaagaattggttagcattgtgtttcaggtttcaaaaaccttgccagtgcttaccattaattgctgtgatcgtattgaagatcaatctatttggaccgtaccgtaccacagagccgaacctgacatggttttcgtaacttgccaagtggccgcgtctccttatagcttgtatgccgccatagagattggtcacttttgcgagaaaaggccctgggatactcttgaatggatgaaaaaaaaagcgacgggagaagattaagaatagctgtccccatgtcaatcaaaatacgtttagaaactgcgagtgctctggacttacccatgcgatgagcagatagagaaaatatgtccctactacacctacaacacccgtccaagccatacttggggtaaaaaaaaggtatagactgttgatttgggtattggtgaggtggctagaatcgaggcttattcgcgtagagagttgtcgagaaaatacacggcgatttgaataagaattagggactgtcacaatctacccgtaagcttaatatgagcttgccagggtcacgactaggaggtggtgtgtgattaatattgtgtcagacaaacagttggaaggggtgtcatccctgtgcttggcaggaaatcctgatttgaatcaaggtaccaacgcgtaagggcattgttacgttgttgaggccgccgtttaatataataagttccattaccaacaaactatcgaaccctgtcacccacgcatgatatgtatcaatcccggcccattttcgtcttaggcaactaaatcacgtcagtatcatgcgggaggtgcgagtcggctacggttttcctcagtaccagatgagttttggcaagcgtcgctgactaggggatgaggagatgatatgtctatatctgacgtatgctcaataatggatggcacagcagaacgagtccaaaacgggttgctatcaagctcgagagtcagacacatatcaaaaagtagttgacaacctatttcgtaaactgttcctagatgaagcggccgtcggggtactttattgcagttcaatgtcgattcggagagaaatacaattactccactacggatttttctagtaaatgtttcttgatactgttcatttgcgaccaggagggcgaggtaatgtctgcttaatgagtcccttgctttgtggtccacggatgctggcttgttgccaagtgtgaatacacctgttctggagcagcgggatactgttcattggtatcccattccactgtgcgaacaataccagaattgtggccgtgtctttcgctcacctcatccgccccgttcccaacaggccgggctgttgtaggcgccagctcatgcccagagtcgccatcctccattctatcatacgggctgattggcatgtctgagaccttcacggcccctttacttgcccagctcccactaccagcagttacagttccccttgaagatttgcgcatggaagtaacccatgatttaatcgatgagaacatactggtgaagaaggggctttgggtaaatagtttgggaatcgctggcacggagagtaccatgatgacgcatgaacactcggatagtccccaaaggtatgccccagtgactgcgtaagtcacatctccttggtaattcaacgtaaacgtagattgaatgcggcccgcggcgcaagcacaagcactatgagggaggttaatgccagcaagacagaagggagtagtggcggagacgtacagcagtccaatggagaagatgatggatactccgagacggcgttgccccgtcatatttagtttccaaatgactcgctgtgggagtagcaggattatgacatccatgaccatattgaataccgtagatggtgcatcaactcttttgcggtcgagacacgttccgtcgatccacctgttccaaatcttctctcgcgggctgcagtaaaaatgcaccacaataatgaaggccagatagaaaaggatattgacaacaatcagtacgtggcaggtccagaagaatttgttccgaacaccgtttggaacaaatatatgagtccattccaaaaggactgccgatttggcgaacagcattgtaaagcaatacattatcgggttaatgtatagccgctagtcagtatggccattagaaagatgttctttattctattatcccaaataaaagccatgtattagggattggaatcttacataggagactttggacatgtcccaggccgagacattccactggtggacccaaagaccgacaacgctcccgattgaaacgccagcccatactacaccggcatagaaaccctgtcttggtcagtatctgtcttggtctcatagagaggtagcagcatacgatggcaataaagcccatgactattcaagagtaagtagatgctccaaggttccacctatggggcagatggagagagggggctcgtaccatcctcagccctaactttccggaggagaaagactcgagtgtatagacgtgttgcgaagcaaagggttgagatggcagtaatgattgatatgcagaccatcccagcaacggtatggttgggggggtcgacgaaatttgacacaataccatcgggaggagtcagtgctggtcttttctccagcatagcctgttgaagtgaaggcggtagtttattgaaattctccattctgtgtaagggtgagccgaagagagatactctaagattaaggactgtagattacgacggttggtgtgaaaaacgactggacattgaagactgactccaacatacgatgacgaatgggatggctcccactgcattaatacctacaggcttaggagataatacggagtaggattttatctaacaaaatattgatttaaaaataaattagaaaaaaaagagaccaagcaggaacggaactaagagatctcggaagaaatgaaattgaggtggttactgaatcaagcgacatcctccgaacgactcagcgtcgcgtccttgaatccttcaaggagatattcatcaaatcagggaatgcttggccgagatatcgcgcaccagattgcgaaatacaagcgccaaactcgctaccacggttgcattcgattgttggggccattttcctgatagtacctgcacgtcgaaacaaactacttttagttggttgctaccataccctatctatccctgtaaatattgataaacgggaaggactacggtgtcgagtgctacgctggagactaggcatgtaccatttcaggggtacgcatttggtttgaaagatgtatccgatcttaggtgtgtgtgtgatatggattagaaatgtatctgtgatatgatgatatccgggatattagatatagggtaggttgatatgtgccttggcatgcaggctgagtcttcgccttaactgggaagtaagcggctgatctcttctctgtaatttacctggcctcatgaagaataaactgctgtcttggagacatgagtcgagggacttattattttcttcaagtgcgttaaggcgttgggcatagtgcgagatattcgctaatggcgtattccaagatcaaggtcctacggggaaatggatgcagtttccggcgttgtttcagcttcaaaagtagcatgttgtttctcagaaggatttatgaagataagcggttcatcgaatgtggcgaaggcattccggaacccacgggaaagggtcatgcatgcacaaggctcatatgtgcacttacgctcgtatttactgctgagaatggtgttattccttggcggcaatgtagcagacaacccgaataggcaccaactgcatacgcttggctctgcgacgtaaaccagccaatgatgcactttgcgtctcattacctagacccctccccctgatggatgccttgcgaaggcgttgagagagcatccatcaatgcaacccgccggtgcctactggctggctgccctctcctgtgccattgacaaaggacctttccgagccccatgtcacaggtgtgtacatctgaacacattgattggttcattccaatgccaacaatgcaacatcatgtgggtgcactcgcccccgtgccattgtcaaaggacctctctggaccccatgttacaggcgtcaacacctgattgattgattaattcattccaatgcaacatgcgggtgcttacccgttggctgtccctctcttgggtggtgccattgtgaaaaagatgctgaccacactcaacttaccgtgttccccggccgcaagcaaagggcattctccgaaagtgtgggatcctattcctttttaaagaagaatccagacctgtaagttgaactaggatgacacatctgtgtctaccatgccaagtggcctgagttgtcgcagtcgcagctaggcattgcaccgttagcccataatggattccatcaacgaacagtcagccgctcagggtggctcagaacaagatcgagatccaaccaccgctattgagccggagggcaagcgtgttcgaaataccgagaagaagagtcccgataccgttgtcttggaaggcagccaggacatcgcctacgaaaatgagattttttatctcgacggccttcgcttctggggcgcctgtgtgctgtaggttgcatggccctaaaccacctgttgacaagctgacagtgccagcctttcgattatgttcttcctggtatccatggagatatccgttgttacaacggccttggtaggtatatcaaaagagctaggggagttcgatagtgtcagttggattttatctagttacctccttggatatgtcgccgttgtcatcattttcgccaagttcagcgatatcttcggccgcagacaaattttggtaacttgtatattcatcttcacagtattctccggcgcctgtggtgcggcacagaccatgactcaactgtaggtccgatgtctgcccaaagagacgtcctctctctcgctccgtgcttcgttcatactgattcttcttgtgaagcatcattcttcgttcgttccaaggaatgggtggcgggggctcatttgcgatgaacatgatctttttgattgaaatggtgcccgccagcaagtatgcacagttggtggccaacatgggcttccccagtgcaatcgcgttgggtttaggaccagtcatcgggggtggaatcacttccaatacgacttggagatgggttttcctcatgaagtatgtaactgatctccccatccatctcaaattctgacgaacttaacagcgttccaattggcgcttctgccatcgccctcgcgtttctcgcgattcctcggaccttcccctactctgagcgttcttcaaccacacttcattggtcatctcttagagcgtttgatcgtgtggatatactgggatctgtattacttctcctagcaacactcgcagtaacggcaggttttgaggaggctgattcacgtttcccatggaagtccgcctacgttatttccttactaacgataggtggcctgctctggatcttattctcgttttgggaacgttacgttactcttgccaaggcaaacagagagcctgttctcccttggagattcttttcggagcgcgccctcgttggtatcctactgtaagcctttttccctctggaaccaactcttcagataggctcattcccaatgtagtggcgaagtaatgttaggcggcccgatgaccgtcactgtatttcagctaccgcagagatttcagatcatcaacgggctatcaagcgtggatgcaggtgtcaggcttgttccatttggagtaactgtaccaattggcgccatgctgggcagccgaattgccgggaacctccgagtcccgcctatttttgtagcgataggtggtgctatctttcaggttgttggatttgctttgttgagtcgattgccttccacccctcagataccacccagtgtctatggctttcaagttctatgcggaattggcgttggtgcaacctaccagagcttgtatattttggtcccgctgatagtgggtatgaaggatcaaggtaagctgaacccaatgtgatcttgtctatacccaatatgtgtctaattattggaatcgttagctgttggaatgggagctgcgacacaattccgcatgatgggcggggctattgttctggccctctcaacttcggtattcaatagccacgtcttgcccgctcttgatgagttaggactatctgggtctaccaaaaatctaccccagaccatggccctgatagagaaaacagaggtgttggcctctttgaggtcaacactatcagaaggatacaatagacagatgtatgtgctatgcgcttccgctgcagcacaagtcttatccgcattactagtcttaaaacgcaagcagtggattctcccggagcaataatgaaatttgaggaaggaatttgagtagttcttatttagtaaaaaaagtgtttccggacatcagatatcgagaccgtggaaactgttatattcaccactataccgcgcattgtatacttagtagccaaagttatttagctctctcaatggttcgctcaatagctcttatagcctcctctaatccttcatctgaacgagacccaggtattccatggcccagctgatgaatggactcctcccttaggctttcatcactaattgttacaagatcttttcccatgttcgcgaactcgccaccttcagttgaccagatgtgcgctgtgggaactcggagcatcacgccgtcttcatcataatttagaaacctcggctctcctttaccatcggaacatgactgtatatcaataggagacagcccgcagaagaagattccacactttagtctaaaaacgggctggggaagctgttcgtcggctatcatgatagtagctgcaacgcaggcgccctcggagaaacctataatgccatcaaagggcttagcgctcgccatgaaattggaaacgctgtcgactatctggccgcacaaggcagggtcatcaggagtaaaaccaaaaaaccgttcatcagactgcctggttttaagaactatgcctgtgttgcccataacagagttagcaatgggcagaggcgttttcataatttgaggatcctaagcacctacccgccatgggctctcgggggacagggccattcaagaagatgaactcatggtctggcgtaaagaattcgcaaattcttgctgataatgggtatattgttaataaggaaacatgcgcaggcacgataaagtcttacccatttggcttcgaagaacctggttacgggacttttagaatgctattggcactgagactttgatattgggtcacacatacctcggcattcattccctttccatgcagacagaggaagcgcatttttcttcttctttggaatgtctctatgtgcaatctagatgcaggaaattagcagccacgcggcatagaaattccttcaactctatcacatttgtgatttaacttcacggaagtcggaatgcgctgtgtttacaaggggtagtatgaaggaaccgttgaccaatgcatgccagggaccagtgtctgagccactgtaaccttgggggggtgagagatttgaaaaaaaaagtgatatgcatacaactgtgatatttcgttgtaccccgtggtcgcaagaaatatcgcttaggtgcaaatgtaaccctttggggtgatattttgtgatagagtgatatgcatacgactctgacagattcttgtgcccctgaaaggcaagtaatatcactctagggtgtaacctgttggcgcgatgtttgcatgcgactttaacctttattgtgcctctaagtggcaggaaatattgctcggagtgctactgtgacccgttgggggcgagctgtttgaacatacttgcgacgcctccatttgagaacgcctccgatttaaaacaaatgtagatatatgcattgcctggaaagatacaaatatgaatatgaataacagtaacgcaagtaagcaagttttaacttattgagagaacgttggaaagaaaaatgttgaaggaacaagaaatcggccacaggcacgtaagtcgccgagagtaacattcctgtgacaattgcactccgtcggtctctacctggatcatgatcctttcatgcatgttacgtggttactatgggccccgatatcaagtgttttgagaaaccaaagaacctccgcggctggcaggcccggcgttggcttctccttgtagtaagggccttatggctgtgttggtgatatgatgggactcgtacttcttcctacctattcaagcaaggtattcgagcaataaaagtcataccgagtgccaaataaaatcaaagtaatcggatgaacacgactgataactatcttctcgtagaataaagccgtagagttatccagagcttgcctatacttcaacgcccgccactgagcctacgctgtggagctagaatcaaatcttgcgcagcctttctcgtgttgacggccaacatggaaccgatcgcgatcgttggcatatctttcaaaatgccccaggaggcatctgacgagtcaagtctttgggaagttattgaaaaaaagaagaacttgatgacagagtggcctcgcgaacgaaccaatattgctgcttttcacaatggaccagaccatgaacctaatatggtcagttagagccacctatttatattgaatctttagatcgaaacgttagctaatgatgatgaacggaacagctttctggccgcggcggtcatttcatggacattgacccagaagcgtttgatgctccattcttctctgtgacagcaaaggaagcagctgctatggatccgcagcagagaatcctcctagaaacatccttccatgcttttgagaatggttagtatttttttaccatgcaccctaatggtaataatatgagtccatggtgttaacgatttcgcagccgggattcccgttgaaaacctgaaaaactcacagatggcagtcttcgaggcttccatgtctgatgactatctaagaatgtattccaaggatccggagagcattccagtctctgcagctacaggcactactgcttctgtccgcgcgaacagaatcagttggtactatggtttgctcggacctagcgttcatgtggataccgcttgttcaagtggaatggtggcggtagatctggcttgtcagtcgatccgaagtggtgacgcttcttcggtatgttgaacaggcgaactataacatctccaaagaattgacatggcatcatttcaatacaaacgttgcacttgtggtgaataaaaaactgactcggtttacaggccctcatcattgggtgtaacctaatgctgagtccggaaatgtctatttctcttagtaaccaaggcttcctgtctccagatagcttgtgctatagcttcgactcccgagctaatggttatgcgagaggagagggcttcgttgctatagttatcaaaccactaactgcagctctggaggatggtgatacaataagagccattattcgatcagttggcacaaatcaagatggacataccccagggttatcgcagccaagtgctgacgcacaagaacgcctcattcgtcatgtgtatgcgaaagcaaatctggatttcaaatatacccgttacttcgaggcccacggtacgtaccctagctttgcattgaacttgaagaaagctatcaatgtgcttttcagccattaataaacttgacaggaactgggacacctactggtgaccccattgagatgaaagccattggaagggtgttccgagcttctcgaaacaaacaagagcctttattcgtgtatgtgagcagcatctcagttctctctccccattccgcaatagaaaccctatatccattgagctaactaatcgatatgtttcgcacagcggctcaattaaatccaatattggccatttggaaggcgggagtggacttgctgggattgtcaaggcagtattgatcttggaacgcggtataatcccgcctaacgctctgttcaaaaaactcaatccagcaatcgatgcttcattctacaacgtacaggtatggtctctgcggattaaatttggtccgtctggctgcatgtggctaaaagagagcaggtcccgacgcaaagctatgcctggcctgatgctgggttacgccgagcatctgtcaactctttcggcatgggcggaacaaacgctcatattgttcttgatgatgcatatcactatatggtaaacaatggcctaagtggtaaccatcaagtgcaagtgtatgttgagcagaatggtaagttgccacagatctccttcttccgccttggtttaacacgaaagtgtgttcttgataggaaatggcgtgtctttgaacaatggagtaagcctaaatggtaatggtgaatctcacgatgatcaaggtactcacagcctcgacgaaaaaccacatttgcgcaatggagtcacctcgtcgcactcttcgacgctgttggtgtggacagctcacgacgcgaatgcattgaagtctctcatccaggacttcaaagtctattatgatgcaaatgtgactggaaagcccatcatggtccagcgattggcacatactctggccacacggcgtagtcgaatgccatggcgagcctttgcacttgtcaatgggtctgataacttggcgacatcaacgccaaatcgagcaagctccgaaagtggcaaagtcgccatgatcttcaccggtcaaggggcacaatatgccggaatgggacaagagcttttccagtacgcagttttcagacaaactatgcaaagggtcaatgacgtttttgcaaaactcggatgtaaatggtcaatatttggtaagctcgtttatatttcattcatttcaccttatgatgatccaataaatattgcaaggaggatgatcatggatgacaatttaataacttcaacgagacacaagagctaatatctatacttagacgaaatattgaaccctgacaccataaacagacccgagtatagtcagcctttatgcaccgctcttcagattgctctcatagagttgctaaaagagtttggggttgtaccagcagctgtcgttggccactcgtctggagagattgctgccgcttatgccgttggggcactttcgctagaggctgccagcgttgtctcatactttcgaggccgattagcaggaactctcgcaggctcttctggtgctatgatgtctgttaatctcgaccaagagaaagcccagcaactcttggacgacatggcttcccagaatggtgacgccggggctccactgcagagcgtccatgtcgcctgcatcaacagcccggtcaattgcaccttatccggtgctgaagcatccattgatatcatcaaaagccggttggatcaggatggaatattcgcccaaaagttcaatactggagggttatcctatcacacccccgccatgaatgccatcgcacccaagtatctcgaagctttgagctcagcgcatgctatgatttcaaatgtagaaagaggaaacaagaacacgggcattccaatgatatcctctgtcactggaaaggtggtcacagcgaaatctctttctagtgcccaatattgggtcgacaatctggtctcgcccgtcagatttctgcaagcaatgcggactatggctggcgatgacattgcagtctcgggcgatcttagctttgtaggctttgatccccaaacgatcactgatattatcgaggttggccctcattcagcgctccggcgcccaatcaaggacacgctacagctctcaactgaaggagaagttcctatgccaaacccaagtttgaggaagcgcaacatcagatatcagtctactcttgtaagaggtaaatcctctctaaatactactctggacctcgttgggaggctgtttacgtatggtcatgctgtctcaatctcagcaagcaacggctacagtagagattccatgggtcctgggaaggacactttgcgcggtggtgttgaaagcacaaagatcttgccagacttaccaaagtatccttttgatcattctcacaaatactggtccgaatcaagaatcagccggggatatagattgcgccatgaaaatatatcagccagtgacggaagcgataggcttctcggaaaaccggtcgatgattggaatccacttgagcccaggtggaagagtcttctaagcatcgaaactcatccttggcttgggggacatgttgtgaataggatcactgtgctgccaggcaccggaatgctggtcatggctatacaggccgcaaggcaccggttttcctacaataaaacgttctcatcgcggcgagtagtcggctactacatcaacgaagctgaattcaaaagcccgataatggttggagacaaagcacaggacgccactgaggtcatcactcagcttcgcaaagttcagggcgaagacaacagcaactcactggagtttgatattgtgatcttttgcatctccaatggagatcgttggaacgaatcatgtcattgccgagttgagttacaattagatgattctcggatgaacgatgtcgatagcggagcggagcaccgcttcgaagaacatgagttgcacgacacataccataccttgaatctcgcctgtcaaaagaagcttgtgcctgatgaattctacaacgcatttagggacaatgtagatgtcgactatggaacgacatttaggctgttggaaaacatcaaatgggatggccatcaccgggctattgcttctgtcgatctggcctctgaatcagtcatcagaaacgccaatacattgcaggtcccggttactgccatgctagatgcttctgttcatcttgttcttactcaggtatcaaagggcctcgtcgaattccaccatactcttgttttacacaaggtaaccggcatgtggatctctgacaaagcatggaatgatgcgaactccctacaaccctctatcgtgagactggcaaactccatggttcgtggcccaagtaagacgggtaacgtcaagagtaccattttcggtttaggtgacgatgattccgtcctctttcgcctcaaacatgttgatatggctgcggtctctcagatcaagggagacgaccttggcagtatcagcaaggagcgcggaaggcttctgcataccattgattggaaaccccaactgagtctcttgaactcggaccaacttggtcagttaatggacaagcaagagccaatggtaggcaacgagagtctcatggtcaagttttatcccaagatggaattcgccatgatcatggcagcccgtaaggctctggaggacggggcacgtgcacccccggggtacttggaaagacttgtggcttcgatcaatgcactatatcttcccgatggggctgtcgccaatgatgatgcggtgaacggcatcgccatatcgcttgagaacggccggatccctcagccaacaaataccatgagtgatgatgagctggagctcttgctgaaagaatgcgaggatgataatccttcctgggaggctttccctgtaattgctcgccagctgaagcccgtaataagcggtgagatggacccgctgaatttgatctttccgaatggtctggccgagaagtactacaaatctctgtttcaacagaactgcgacaaccgtttccgactctttctagagctactgtgccatgaaacacctggaatctctgtgctcgaggttggcggtggaaccgggggtatgactgagcagttcctgtcagctatctccgagatagagagcacgaaggggatcacgtgtatatcagagtacacatttaccgacatctcaccagctttcttcgaacatgcaagcgagaagtttggagattactcggagcggatgattatgaaaaagttcgacctggagcgcgaacctgaggaggaaggttttgagccagcaacatatgacgttgtcgttgcgggaagtgtggttcatgccacgcgtgatgttacgaaaacacttgagaatctccgaagacttatcaaaccggggggctacctgatcctccttgaaatcgtcgatgctggctctgcaagtggcaatgtgggtttcggtgtcttccctggctggtggctaagctctgaggagtggcgtccccacagcccgttgttgacagaaaaacagtgggatgtgcttctcaagcaaacagggtactccggcaatcatcttgtgcttcgagactatgccagtgatatttgtcacatctccagcatcattgtgtcaaaaattgtcggtgacgacaccatacagatccctcgtcccacaaacggtgtcgaccactctcgtacgattacttctccatatcaaatgattgttcttgttgataaacaatcctcggcccaggctcaccttgcggaactgctgctgcaaaagggccagaagaatgggaacacaattaaggttcagctctggtcaagtgagcttcagcaacctgaatacttgaattctattctgcaagaagacacagttgtcatctcactcttagaagttggccagccatttttctccagaatatgtggagaagattttgccacacttaaaagtttcatcagaactgtacgcaatcttttttgggtaacatacatggacgttgaggatccagaatttgcatcttcttcattaatgaagggctttttccgcactatacgatctgaagcagtagaaaagaatattgttaccttatctttggatggtatagccgacacggtctcgtttcagacgtggactgacgatgcttatcaggcagtggtgggctacatattgaccaccgtgtttgggacgttcgtaccctctgcggggagttcaactcctctagttgcgaaggaactagagtatgttgttgaagcaggcatgagctgcattgggagactcgtagaggagtcaagcatgaaccagaagctgcaaaccatccttagccctcaactgagaagcgagccatggtccacaggtccaggagttgtgctgaatgtaggaacccctggcgcattggacactttgcatttcgtggaagatcccacaaaccaccaaccgcttggccccgacgagatcgagattgagccgagggcttggcctgtcaactttagagacatactgattgccctgggccgtatagagtatgacactttaggcatggagtgtgccggaattgttacaaagattggtgctaactacgataacgagcggtctgggctgtctattggcgatagggtctgtatctgttcatacggaagtatacgcaggtacgcgcgaagccacgccgaattggtgtacaagatccctgataatgtctcgttcgaagccgccgtatcggccatcacacccggtactacggcgtattatggattgattgatcttgcacggttaaaaccgggtgaatcagtcctcatacactcggcagccggtgcgacagggcagatggcagttcacgtcgctcaattctgcggtgcaactgtctttgctactgtgggccatgatgagaagaaaaagttcctcgtcgataactttggcttacaagaagatcatatattttacagccgtgattcttccttcaaacagggaatcaagcgcatgactggaggtcgcggagttgatgttgtcttcaactccctgtctggaaagggcttacgagcatcctgggagtgtgttgctccttacgggcgctttcttgatatcagcaaggcagacatgattgcaaatgcctctcttccgatgtctgcattccagggcaatgttagttattttggcattgatgttcatcatatgggaaaccataacatagccgccatgaagactttattcacaagggtcatgagtttacttgaagatggaactatctaccacccaaagccgctacattgctattctataacaaatatcgaaaatgcgctgcgtttcatgcaaggtgggaaaaatattggaagagttattattactgcctctccgacggatgtggtcccggtacgtatcggctcaagccgcgttcgcttgtgtagatgctaatttctgaaatcctagaagctgagccgtgaccctgatttatggacactcaaccctttggtttcctaccttattgtagggggtctgggaggacttggtcgtgcgattctcgcttggatggcaaacaaaggtgccaggcacctgattgtgctttcaagatcaggactctcagagtcaaacactgaagcgattcgaacagtgaaagaattacgagaacgaggtgttacaatcataactccaacatgtgatgcctcatcactgcccgatttatcaactcagcttgctcaatgcgctgagaccatgcccgcgatagctggctgcatcaatgcagcgatgagcctccaagatgctgttttcgagaacatgacatatgagcaatgggcacttaccattgactccaaggtgaagacaacattcaatcttcatcaactgcttccagttggctcattagacttcttcgttttattctcgtcactctccggaatctatggaagtatcgcgcaatcaaactatgcagccggatgcacatttcaggacgcgatagctaaacaacgggcatccagaggcgagaatgctgtatccctggacatcggctggatgcgaacaatcggtatcattgcagagaaaacagaatatcaacgcaatcgagaaaacactggcgatatgatggcaatcgaatcggaggagctactgggagtcctaagccaagtctgcaggccagccatatccaatgccaggcaccaagtgctcattggggccgtcacccccgagcacttctacgcaaggggtaagaacccggcgccgtcgcttcaacgccctctgttttcaggatttgggaccagaactggcagccgtttcaaagcaacaaaccaggagaactcgacagaggatgaaccgagcaaactgttcaaacaagcaactagttcaaaggagaaggccctcgttgttgctcgagctatcattatcaggatagctcgtgcccttgcgattccggtagaggaagttgagtccagtaaacagctgtctgactatggtgtcgactctttgatggcagttgaacttcgtaactggattggcagagatttccaaactaacgtcgctgtgtttgagattatgagtggcacaactatacaagggctgggccaattagttgctgaacgagctggataatggaacgctatggaagaatatttcgagtagacaacttatgagctgcatctcttactaccgggtctttataatacctagaaatgggtggtcgaggaaattggtcaaataatttattatgatttatcatgtctctcccatgtgcttcggtcggatgatggtgattaccaaccataatcctactgccgctccaatcaataaacgctcacgtcatgttaacactgtgacaatttacgcgtattggagtaattctccgcacgatgagcgcgaattgtttcatttagacatcccagaatctttttcacttttacagagtcattaccttagagcaactattattgaatcgttttcctttggccgccatcatgaaattgcttcaattactgccttttcttacccttgtccgctgttacaaagacaatcacacaatgaaaggagtgaaagtcattatcgacacggacttcaatacaatcggggatgatggtcaggtccttgccatggccgcccaaatgcacgccagccaggacatacacttgttgggtcttaccatcgtcacgggtaaccagtggctgcaccaagaagtatcggactgtctcagggccgtggagcgcgtcgggcttgagaaacaagtgggcgtctacgttggcgcggaaacgccactactacatgacttttcatcgttccagctagagcaaattctatttggcaatgcgaccgcatatgtcggtgcatatctatcggcaccaaagccgctcctcccacctccagacggcttcgcgacgcacacggttccgcggaaacagcatgccatcgacttcatcatcgagagtgtccaccgctatccaggtgaggttacactgctcgccattggaccgctgacaaatatcgcgctcgcgatacgcaaggatcccaccattgtgcccctcattaagtaaattgtcatcatgggtgggcaaatctacgctccaggaaactcgtatatcggcgccggtgagaccaactggtggtttgaccctgaagctgctcgtattgtgctacgggccaatattactcgtaaaatcgtgcctctcgatgtcacaaacacagttgtcatgacagaagagttgtatgatagaatcgcagagtacgagcccgaaacccctatcacgacgctgtttgcgggtattgagcgttggagttatgtgtacgacactgttgcactggcttcactgtatgatccaagtctggacctcgatgtgcgagacttgtacgtcgatgtgaactgtgacttcaacgcaacttatggcaaatcgcttgtgtggaacgagaatccctatcccggcatcgacgtctactcgacttcatctgtggtctttaaggttgacaatgatcgtttctttgacttgtatgtcgacttgcttacacggccagtgccagttgtcctaagtacaggtgcgcgtgatgccagctgggaatcaagtgtgtaataactgcatccaagatgagtgacaagcgctggtattctaaaggtgctcaataatgttctagttatcttcagcgattccctggatcctactacgctgcttctgcttaaggcgactggaggtgattgcagcatattgttctttcacttgacttacctcaaaatatacacagtagtctcaatgtaattgtgttccattctgacttgtcatacatgcggtcataatacagcactcttaaactactattttgaaccatcttagtaataaataggtacttctgttttagttctcaaatgataaacagcctcttgttcatctagtggcacgtcctagttgtcgaaaattggaaattggtatcgttcgagactccaatagtgtaattctctttctggtcgacggtgtggaaaaaccaccccatccggaatcgtgtatctgccaaacgtcgataaagaagacttgggggcatcagatgcgcaccctttgataggtgatggatggcatttgtggagcaaagcaatgtatggatcaatgcaatactgccaaatccatcaggagccagccctctaagctccatatcaagcaaacagcgataccccctcccgtatcggcgaattagcatgcctgatatcagagcatggatattggtaatggcagccaatgctaagatcgccaccaagacatagggaacgacggggtcttgcaccagtcgacgcctgttggtgttgataagctttgccttaattggcctctggtttggtgattgagttggttacccttttgaggattcagccagtcgattctgcttgcttgctatttgcacactagcaaggccgagagtgtgatgtagtgcatcacttattcagagaaaaggcttagcgttggcaattctacgccaagctaattcgggttgccgatgcgatcgaggcagctatgctgagtataaaatcggctaccattccaccacggtaccgccaagtttgcagcatcacactctcacaaattttcttcttatttttacacagacatccatcgcaacttatctgaaacaatgcatacaggccagtgtcattgcggtgcagtcaagatcgaaatacgtggtgagccagcagctatagtaagtaattccccagagcgcgactgtcgccaataatgggtttaagttcacatacgatttctctcagggccagtgcttctgtcgcgactgtcgcagaacgtcgggaggtaccaatgcactgaactggtttgttccggccgagcaactcaagctcgaaggtaaaggcggtttgtcgttcttcgagacaagcagtactgacggcttattggcaggtaatccgaaaacgtacgccatgaagggtggtagcggccagcttgtgaccaactacttttgcgccaattgcggtgtgaccttgtaccgcgagggcgaggtaatgcctggaactttgttcgtaaaggcaggcgttttggacgacatccaagctgtcaatcaacttcgcccccacggagagatattcgtgcgtgctcggcctgattgggtaactcctgtcgcaggagcttcacagaagcaggaaatgctataggttacctcgatgatctgggatagctagatttgcgacgtatgtaaaacaagcagaggctgcagtttattcctattcgaatgtagccagtgccacgatgtagccatcgcttgatgccgccgagctagcatgcttcgaaacacgctcggtcatcggccggctagagagcatatacctaacccggtagaagctccaagatggcgtaggatgcctttgattcggtcttgcgaatcggaagctgcgagacgagattgcatgagtgcactcagaggccacatcatgcaaaatgcgcggtatccgaggcaactggaaaccgtaggcgtgttctcttctcttaataccatcgacacagcgtcgtaggtttcttgccagctcgatgtatccgaaattgtgtcaagccttgtatccaaaacagaagtcatttgaggatatgcgagaagaaaatcccagacgctctccactaagtgcagcttgacggtcaaatacagagcctttgccactgctgcgtccttctcattggctactgatatcagataattgaacgctaaggtcggcactgacgacacgggctttgaaccgacggcgtccgctgattttttcaactcatctgcaactgccaaaccgctctttattatgtcacatatacgagacagagcatcttcagtgtgtagtgatatggaaggggcgcagtccatcgtggatttgaattgaaccgcgcgccaaagcagcggttcaagaacaggtccgacagtgctcgctgccttcgcagtgagcagacgagaccagagaggagctgaaccaggcggtgatagaaaatattccatgagctaataggattatgtcagttgcaatgtgggaaacggtcacacgtaacacactcaccgcaatatagctgaagaatgtatgtgtgctgacatcaactgccgtgtggataacattgtcagctctgtattccagcagcaccaatcctcctctagaatgggggtggcagttgctttcagtgtttgtagaccagattggggagtgttccgccgcaattgtctgaccgccgtcagttaaccgagtccaggttcacaccgacaaggaggggagcggccataaggtcaagtgtcatacgcacctcgaacaatccaagaacaaagagtgacacaagaactgtatcatccttggcagtaacaggatcacacagcgcattattcagggagttgattgctctaccgtagttcctcctcgccagcgccatcatgttggactggcaaaatcgccgggcggcgctcgctaaggcggcggcttccaaagcactctgcaacggtccaccgggagttttggagcaaattaccggcagagttctgaagaaggaaataccggaggcagaaacgtagctttcatggaagagtaggagtgactcgtattcgagcgagaggtgcacgggtttaggtagttgcggcctgccagcggcgaaacgtctagcctggaggcgtttgcgtactcgaacttgaacctgctcggcgaccaggtcgttaacctgccgcaacacaacagtccaggggtcggaatagccgagacattcccgcttcaacaataagcatctccggcatgcaggtcgttgcatatcgcacttcccaccatcaaatgcccttgtcagctacgtcttcaaagagaggaaccatgtgcataccttaaccttcctcttcctacacgtcaagcagccactggacggtttgcccgtattcaccatcttgttcaacggcacaggcgacgacgaacaaacgaagttgagaggtgtggcgaccgtcggcacacgaacggtccgacaggctgggctgtggtgagatgtgtataattcagcacctggcgtaaagtaagttatagtggattggctcaaatttgtttccggcggtgctctgtatttgtcatgtggtgtgcacgccaaaccatttgcggccgctcatgcgatcgtggggcacaaagatttggcttaaccttttgtgggtgccgatgcgatcactgtcaacctccttaccaattgaggattctaatgcggtctcagcttacaaggtagattctgagcgagttcggtgcaacatgtgaaaacctgttctcgcggactgccgttcgtgcaccttgctagcagcgtgtctacatgcttataaaagcatggctgattcccagctatggcacctctatctaattgtaacccatccgattgaccacgcttcgaatcattttagccttccgtctttcggaagctccctgaactcgctgtacataaccttgcctcgcacgatgctggacctccagtccattagagaaagcaactcccagttacgggaggggcagcctgagtttgttgctgtgatgggtgcgtacgtccgccgtctggagaagcaaacgctaacagcctacagtgggtgctaccagtggcattggcgaggctacttgcagggagctagtccgcaacgtaccgcgcccaactgtttatatcgtcggacggaacgaatcgagggcgagcgctctgctggttgagttgcgggccgtaaatccggctgcgcagattcactttttccgggaggacgtagcactcttggaaaacgtcgacgacgtttgcaaacgaattgctgccgaggctggtcacgttaacttactgtttctcagcgccaatgtcttgcggatggcccgttcccgtatgtgacgtccacgcccattgtcagcgaaattcagctaatttattggcagccacatctgaagggatcgatcaaatgatggctctacaatattattcgagagtacgatttataacgaatctgttgccaaacttgcaaagagctggctctaagggtgagctggcacgtgtcgtttcagtgctgggtgctggtaaggagggcaagatttttcacaacgacttgttgcttgaacaaaacttcagcctatcaaactgtgcggcgcaagccatttgcatgacttcgctagcttttgagcacctggctgaggagaacggcgctgtgtcgttcctccacgtctccccaggtgtcgtgcggggaactgctatcactacagggtttggtcgtgtcgtcagcgcagtcagtcgcgtgctcatgacgttggcgattcctttcactgtttcggtggaggagtccggtgagcgccacctctatttcagcacgaataagagctacgagcctactcgggcccagccaccactacgctcgtttcgcttggacttcaaagggcaggtttgccccattccggatctcctggctcagtatctgaaagacgggacccaaaatgaggtttggtctcacaccacggacattttcaccagtgtgggtaggaaatctgcgtaagttgcgctatattttcggttgttaaatagagcttgtctttcttgttcgcgttatctagttcgctataatgtcactcttctacgccgatctgttctagctaccggttggtgcaagtgtatgccaatcaaagggacacgaagaaatatcatcctacgatcgttttgcctcaaaaattaaagaatagcgaagtaattcgcgcgcttggcctggtgaaagagtgtgagagttacagtaggtggctttgcttaagagcccgccgcgagcgaggcggccgtttctctctctgttaaagaagcatattcatagtcattcgggtactgtcgcccacctgcctaatttggattattttcgctgcatgtgtcaacggctactgagcatgaactacaccaagtaatgtaagggtgggagttggcggggtacatagtccaaagtagttgctaaggaagatatgactctaaatacaggtaccaatgcggccatatgggttttttgaggtacttgcatccaatagaggacatgtaaaatagtacatttactggggtcaggtagagagaaataggtcttttttttgaaagtctcatagcttcctatggggacattttgggttgataatgtctcacaacacatttcggagacaagggatgcgagccgaagaacgagggaaaaggtactaaacacatattgatcaatgataatctagatatatcagatatacagcattatcggtatttgtcccacttttctccaaagggcgcttctacattccttgagggtgtcgattgatcatgggcacagcgcggtagcaaacaaccatttcatgggatcatcgtgagtctaactcgcgaccaaatcttcaaaaatcttcagtcatccagtaataccagattcaagcgatgatgagtgattattgccaggctcgttcggggtggtatgtgacttgacctcctggctttaggggtccttaccatcgacacattttggacatggcaacatgcctagtagagactaaaggtctaggtgattatattaagtatataccttgactaatgagcgtatatgcttcgcccttcccgagagcataccgcccgcccaggctgcgactgatcctctatctcgaagctgtcagggacaagattgccatctttgagagccgtgaatcttattggcacaaggttgatgacaaagacgttcggccattgtcaacagtcatcctcaaccagagtaagaaagagcttttactggaagatttcagaaacttgctgaatgaagatacacaactctggtatacgcagcgcgccctcccatatcgtcgcggctaccttttgtatggccctcccagcaccggtaagtctagtttgagcttctccatagctggcgaattcgatctagacatctttgtcatcagtattcccgactgtacggatcgacatctacgagatttgtttgaggatttgccacagacatgtgtcagaattaaatataactaattcattatgttgacatgtcgggtttggcaccttccattgctgtttttattttggactcaaaacccttatccgaagctgaccgtagtgtttatgaaatcttttaagataaagctatctaaagttacaggccccaaaagcgttgctctcggttgtgagaagagcgcgtcgcgctgaatctggctgcttgaggctgactacaggggaagatgagaaaacaacgggtgactgttgctaatataaccatggcggaggcagttgcttaattctgttatacgaaaatatctaaatttctccgctctaccagccggtgacgaatctttaactacctaatctggcatccctttgttggcaaggacttatcaactgatggttgttgcagggtaggctcatctaatgaaggtggttcgtggactaacactgctcgctgatgtatacccgaacaggaaaatggctcgtgctttcggaacacggcgtcagagcttattgttctttatttacgcgggagtagaggtggagaggggcagcaaggggcgctgctgggttgaatcgtgcttcggaattctgttctggcctcttacaggacaatttggtctggctcgttgccattttcttacggcagatatcacatactgcacagtaattggttagacttcatttccatatgatgctggtagtgactgagcaacagatctgaatcttgatgtttcatttgcccctccgatctattccgatatgtcagcggagattagcataagcataataagcacttcatttgctagggtgcatcatccgataaaaagtttcgatataaaacctctattagcatcggtcgtaggggaaaagagattcctccaaccatacgcttcatttataaaggcaaaatggcggatatcacccacgactgcattatagtcggcgccggatactcgggactcgccgccgccaaagctctggttgagcacgaaacgaagccaacaatccttgttcttgaggcgcgtgaacgcatcggcgggcgcgccaaaaccatccatcgcgacgatggcacatactgggacgtcggcggctcgttcctcggcaagaagcaggatctcatgtacggcctcgcacgcgagtacaaggtcgaggtcttccccataccccaaaagggcaagctcgtgtttcttcatcgcggccgggcgaaggagtattcggggctgattccaccgcttcggccgtgggagattatcgacagtggcatattgctgcaaaagctcgagaagaaagtccgcagcgtagatgtcaatgcgccatgggcacatagcaaggccaaggcctgggatagcacatcactcgacgaatgggtaaagcgacactcgttcaccaagggatgtcgggatatgatggacctgggcttccagggagtctttgggcggccaggcggcgacatctcgcttttgttcgctgcctatgtgttcaagacgctgggcggcgttgaggcagccttcagctcaaaggatggactccaacaggacatgatggtaggcggcggtatggccattgccaaattaatctgggagggaattggcggtgacgagattgtcaaattgaacgagccggtgcaccaggtcaagtacgatgactcgggctgcaccatcacctcagccaagggcgagtatcgcgccaaacgcgtcatcttcacgataccacctcagttcgccgccaaggtgcaattcgaaccgagccttccgacagaaaagcaggccctcctcgaggcaatagaactcggcgtatacgcaaaagtctttgctacttatgcgaccccgttttggcgagatcgcggtctccgcggcgaggcaacgaatctcgacggatacttccccattgtctttgacgccacgtcgccgggagccgattccaagggcaagctgatggcttttctcaccgggcccaaatgccgggagtttgcggctctgtcagaggacgagcggaggaagattgcgattgaagagttcgcgggcctgttcggtaaggaagctctggagccagacgagttcttttaccattcaatgctccatgacgagtggtcgggtgggtgcccgctcgcttcacctccgccaggcatcatcagctcgtacggtgaatggatccggaaacctgtaggacccattcattgggccggaactgaaacatccacaagaatgtacggatatatggaaggcgcagtgtgtgctggacaacgggcggcgaaagaggttgtcgaggccctgagcgtcgagtcagtgcaaagttaaagcaacccagtcccacgactcaacaatcagaacttggacaattattttcaataaatcgggtgattagaagcacaatccactccactccgaatcagctcctactgaatcattctgagttccatgttggaaaccagaaagttaatcttggaacttgcatacccaactgtttcatttgtgattgtatattatatacaatatgttttgatttttcagttcgcttcactctatagagactaattttatcagattcatggcagtataacagagcaagttagagcggtacctaataagatttattcagcgtgaaaacgcccgagaatgatggtgggaaccttaagtcgcgatatattacatagaatgagtttaatgtgatttatctgtaattatccaattcttcgtaacatgcctgctaatgcaagggcagaattaggatggaatctgaaattctgtaggtgtaagtggccatttctgtctgtcttcgttttacttttgtaggctgctaagattggcttctaagatacagcaagacaaagtccacatggcatcccgatgctaccacgctcgtagagttctcactcctcatgaccatggcggctgtcattttgtgcttgctgacaatcggggggatcttgcaattaccggagggacgggcgatgttccaagttcatttcgtagatgttatggaatcactgagacagaatctctataataacttatgataattgtgcaattgtgaaggcgcaaggttcttacttccaccgagtcattttcgaaaaaagaaagtcagtgtcttagatcatttcgcataacaggtcagagacttttcaagcctgcatttcctagtcttctcaaatatatgccctgtatcttacgcctcttcctctagtttcttgagcctgatatcagttgatggagtatacccagcttcctcctccataggcgttgacttggacacagtccagaccgcaggcaaggcaatgaccaaagcgccaatgcacaaaccccagtccatcccaagctgcgtcctaccactagccccctgcgcattgatacgccacgccatggctcctcccgtagcttggaaggtcttgtaggcaccgacaagaaccgcagcacgaccggcgctattcgactcagtcccgatcatccagtaagcaaatccttgccagagggcgtcataagcgccatagaaaatgtacaagaagattggaccagtcgaaagattcccttgggtatagtcgatatcctgcttgagcccttgggccaagcgttcttcatgccacagctcaaacgcgtagcctccgccccagaccgccatgccggtgacaagaagaaacccccagccgaggcgggcacgccctgggcggtcgaggcaaggcagatccagcagaaacccgatgagcattccccccaacatctgcgcgatccagtatagcgcactattcagcgagcgggtgcggatattgaaggttaggccgttgacattattctgttggtagctgtaaaagacattggccgagaaaaaaagaggtatcatgcaagcgacacgccacttgaagagagtactgactgccgtttgtacagcacctttcatggtccgcttctccgtctccgctgcgttgtgtagctgtgccaggcggatgcgagaaggagagcagatgaatatacccagcaaccagccgaatcccataatgaccagcagcgcgatataagtggaatcggaaacggtgctcgttttggaattataattgaggccaaaggacacgagagagccaatccctcctcctagattgaaaatgatccagaacgctgctatagcccgccccttttgggattcctcaacataagtcgtcatgatggccccttggacgatccagatgaaagaggcaccgactccgagaagggctcctgaagcaatcacgaaagccccattgtggtgatggttgaagtgtaagaggctgccgctatacagggcgtatgtccagccaccgatgagaaagcaaactcggggtcccacgcgggtgaacaagggcccaactaccaaaagagccgtaccggccgtcgcggatagaagagctacgttggcgttcgcagcgacggtcgaatcaacctggccagatccgcccaggccggtcaaggcattgtacatcttcggctacgtcttagcattgcggacattgagactagccggatattctaggttgaagacttacaccagggaggcagaaacatatgaagctgatcagaatgatctgagtccacggatgagagtaaaatctcacaagcttcgaggatgatggttgccactgggcactttcttgttgagggatgtccccttcggtaacttggggaacattcttggcgtttgattccgccatgtttcagccttcttctttctgctttgcttgataaaggtacagacaggataaaaagactactgtcaactgcattcgtgtggaagttgcggaaacatgttggtaaactacacgcttaaatagaaacaggaaaggatggagaaagatggagaaaaggaggagtttccttatctgtggggtgcggaccctctcggtccaacttgacggagattttgcggccaagtagtaagaagtcaaccgtcagccgtcggataacccgaaggggactaagaaatctgcagagtggataactaaacgaggcatatcataatgtcaaaagcctgtatatattcgttcaaacaatttaacattctccgatgcacaaaagatctgaacaaagccagcataagcagagtaagatgacagtcatccgacctaaccagggtgcagatcacgccccagttctcaacacgaggggcacaggcaatcccaatgaccagaatcgccccgccgccttggtcctttgcgtggatgcaggaggtactagctgcaaagcagccgccctgtcggccgacggggaacttgcgtcaagtgtgggcggaccatgcaatgtgtaatatgcccgatatgatacccaaagagactatcatccatgtactgataacgtgtactagttccactgtaggactcgacaccacccttgcgaccataacggccgtggtacacgatgtccttcgtaagcatccgtcgacaagaggtcagtcaccgacagcagcgtttactaaagtctggattggcttggcgggatacgacagaccaacacttcaaccaatcatcaatgacgcactttctcagttgtttgggctctcgctcagtgggagcttgcgagtatcttcagacattgatctccttcctgcttgcctcatgtccaagcctgatataatctcggccatcgttctagtggttggtactggttctgtggcaatgagttacaaacgaaaaggcaaagaatttgaacgggttggccgagtagggggctggggaagactccttggcgatgaaggttcaggatatgcaatcggccgagaggggatccgcagggcactaaaggactgcgacgcacacgctctaaggaaaagtactgccgatggactagcctgtttttcgccgctttctcgggaggttttggaatacttccagcgtcggaatgccgattgcacgccggaaaccctccttagccatatcctcattcgaagtacgataggaaacctaggagaggatgacgacgcatcgagaacaaagacaatagcaagtgccgcctctgccgtttttgcagctgttgagaaagacgccgaggcaaaggagattttggaatcaggtgcatccaacgtggcagaactcgtgcgggtgctggtcaaggagcaaatcatcaatgtaagccaatgtgctctcgttcttggcggaggtctcatgggcaacatcatgtatagagatgcagtgcgcgccatcatacaggagcaatgtggcaagtttaatcaggtcaagtttattaacgagcctgccgtgtctgccgcaaagagcctgtttgatcacagccaggactctttgtagtacgatatatctcttctctatagagtatggttgttgaaactattcatcttgattttaggcaataattcatggctgccacgaacatacgagaaacccgtatcagccatagtgacttgtagctggggtattcttgcttttccagagaggtattttgccttccgaattgaaacaaacattggattgtactatcttatcatgatagcagaggggatgagagcagatttgtggatcatgtgcagggtcacagccatggttcgttcagggaagtgtgtctcctaacgggttatccgtggaataccggataacccgtacgctgacaagtcagtccgatattaagattagtaactcctcaaatgattcaccatctggcaattttaagccctgcaatgattcggaagagtagcttgatcatttcggtacgcctcgaggcgccttgcactcagttctagcactaaaacttgaaatagtttgactttgttgaagtttgaagcccgcatgtcgctgtgtgccgtcttcggacatggctcaaatgtagatgctgggaactggacaaaccggacagcaagggatgcatttatgatacttctgatcacaagttattatataaattgataccctggctcagcgtggaaggacgtcgtgacaggtaattaggtagaacaaaactcgtagggtattcgaacttggttctatatttatcataataaccaataattatttactatcaaaataaacaactacttaaataaataaacaagagaaagcattagttcaactcaattagttttatacctctattacttttaaggccaatgcatacattaatagcgataacaccagtattagttctagggttcaaaggctagttaccgcctcgatgtaaagacaactgatcgatgggatcgcccgatatgttggcccgaatcttactcaacacctacggcagtacctaggtgatgctacctaggtatgcaacatgatgtagccgcaaatccaatcattttagacgttggacggaaaactgtagtgtatactctaagccaattcgccttcgtcagtttagctcgattatagactcttctcttgctcgtctcgtgattccccgcaccagatccctgtacagatttcacaagtggcgcggggtaaagtaatttgatagcggagtttaagctaccctaagcatctctgatgttatccagaatatgcccttcccctagcctttaaagcattccaccaatctaaaattcaaggattcaagggaagaaatatttcttacacgtaaatatccattaaagagttgaactcacctagacagctacttgtgtggttgagaaaaaaggacaaggttaggcttctgcgtctatcttttggtaaacggtcagttcttcggcttttatgcacacagattatccaaaccacaacgtctcgcattgagtattccaagtccctacctctccgcttccatcgtcgcatctacatccccataagtttcatgtacaagcgagagatgcctcattactcgagaattctaagcgcaacacgcaagctccaggtcaaaccggccccccgtacaccgccacactggcgcgctgctcacgcaatcccccaaaacatggctcgccaactcacagatgctgatgcgccctggggcttggtcgtgtaccgcggttcattgagcaacgatgaagcttgggagcgtatgttgatgcggccctcgaggggcagcaggaacaggcgcagcgccacgacttggtcgtcgtggctgaccgatccaggtttgacggcaaaggacccgattagatccggcatcactttaataattgggttttcgacgagctccgacgtaactggtctcacggcacgcaacctcccagcaaagacgctcttctcaacgctacaggaagcacggattacttagaccaatctggcccacgctccaatttctgtcttctcgttaacgacatctgtctcgagtcacttgtcaagatggctattcccgttgcgaagctcatcagcagacgctagacccaggacggagagaggcagcgagggagtgttgctgatgatacaaaccccggttgggagggcgggcggagtgacaaacaatgagtttgaggatgtgggctggacgtacgtgcaggtgtgcgactatgggaatgtgcagagtcagctggaagagggtgataattgggcggatgtttaagtacgtccaacgtttgatgcgctttgagaccgagttcaaggatgcgcccgggttttggcgttgtggcggttctttgtgtgatagaaccgaaagtgtcggttgatggaagctggggaacaagtcaaacccgcgacttgattacctgactttacgtaaatgagtgagtcaaggttgagataggcttgtggaaattggagtatctatccacaaagcggagaaggtttgaaaaccccctattagatttaaatccttcgtggacgccttcgaaacccgcaaaagcgatttggaaacatattgttcttgacttgcagtatttattagttagttcacgacccatcttggacagtacacttcctaactacctagccttaatagatataccggaagctgagattctccaagtccgtcttatctgagaaattgtccatgtcatcctgagagtctaaaggagctccactatcctgagcttgtactttatcgcgtcttcggttttctcgtttcagataaaacagtaggacaagcgcttcaataaacacagctgcccaacagcctatcattccgacaaatccagagggatatgtaggcgcctcccgtgcactaaacatctgtggtcctatcatattgccgacacagtatccgataaatgcctaaaaagggcatggatgtgagccgtgtcttcaagactagaggagatatcattagtacttaccaccgcgtttaccgtagccttcctagtgaaaccgcccacgtttgacgaaaccaaagacatcttcatcggaacaccagccgcaaacgacatcataagacaaactccaaagaaccgcggccagagcttctcgacgggtagaaaacgaaccatgaacccgcctgctatgcagatcaagttgaaaatgcacatccacattattctggcattttgcatgtactggcagccgacgatacccatcccaatgaaaatcacctggaacccatacgtggccatcttcagcaaaatggtttcaagcgttccaaaaccgattcccttgataatgaggctactgaactatgattgacagttagtacgactcaataagatttgatctgaagagatggtcgacttgcattagtgatgcctccattggggatagcggcagtgacttgaagcaggaagatcaacaaacataaagggtcctttaagctaataagagcctggtcaatcttaaatttgttgttctttatgccggtcttattctcttggacacgggtgatcgcctttttcctgtcctgcttgttcaaaaaccgggatgtcatgggcgtatcggggaaaatgtacaccattgataacccccagagcaggttgatgcttccgacgacaagaaagcccgcctgtatacgttagagcaagctacgaggtgggagtgagcacacacttaccctccacgaagagaaggacttcagatgccccatgccatagaagattatgctgccgacaaacccgccaatcgagttgcctaggaaccacacgccaatgcgagaggtttgctcactgcgcttgtaccacatagccgtcaccatgttgaagcccggtgatatagccgactccgtggcgccgagaaagaacctcacggcaagaaggcccgcggcgttctgaagtgcagctgtgcaaaggagtactatggcccagccgacccttttccgccagttagtaaaaaaataattgcgagaatagaaaagtggatggacttacattgtggccgcgaggacctttcccaggggaagttttaccatgaggaaagcgagtgggtagcaagcaacaagatagccgatgtagaagatgctccccgcccacgaatattcattgccagtagcgcgtatatcctgggtcataccgagaacagcagcatctactaatgtattcttgtcgataaattggaggcagtaggtgacggtcatgatagggataagactagagtactctagtgtttagtattgtgcatataccaattggaataaccttttaggcagtaaactcaccagagatcaatccttcgacggatgcgggcatcatcttcaggggtgagttggtactgaaagtcggcgatctcgccatcctgtagaatcacctctccctctcgaatctccatttctggctttcccgcttcgttgtatttagtggtcttgaccaactcgatatcggtgttttgagtcatgatcaataattgttaagtattgagtacttgatgaagagtggttggagtagtagacctagaagcgaagaaagcaaaccaggcgacgatatttatgttcgaaggtggtccacaagggcttgcaagaatctggggaacgcttaatccgctatctatgccctaggtgcaattggttatcaccccgcacagtgggtggcgtaatgatagatagccaagattcctccggtccgcacccgacggcttagactccggaaccgtggaatctagaccaacctgcgataacacaagcacactatgtcttcctctatattccttggatattacttggctaccggaacggctctttgcccgattctacatccgactattgtaaacaaagtcatgatagaccagccacaagggactactatcagcttacaaaccgatcatactcatacttggtcgagtcttaaaatttagctcttttgattaaaaatataatgaacgtttaagttgtgcctagaaagctcatggtaacaatggcattttacagttacattgaaagatagatatagtgtccacatccagaggatgctgatttgtcctcatgagacgaaggagtccatcacacagcctggacaccaacgtttcagaaagatatttctactctcttatagttcagacgcaaaaagagctatttggtcgactgaattctcttgtgtgtcatcaagaggctttgggatccccgccacacctcgaacatccaccatagtactggtggaaaggacgttgccagatttgtccagggcctttgcgtacacaccgctaccttcgccaccgcactgcattttatgactaggtactgttagttttgtttcaaacgacttcctctcaacttcccctagggatcgggccccgaggacccgggaattagcccctccaacacattggtaataaaactgccaagctgtggtgaccgtgtcgccattccagctaacataaatcgtcgtgtccttgttttccgtgagggcaactatagcgggcgtctcagatgagaaacctgtccactcgtaacggaagccacgatagctttgaacacccggtgctagagcgccagagtcgaggtaggcgtgaaaaataggagtcccatcagggcgaaattcggtcacagcaccctcctggccccagttgacaaagacgttttgattatggagtacctggacattgccctgggacggaacagagagcatatcggggggtatgaacgtcttcacctccttggccgtattgtccgtgttgttaagctgaacgatccgagcgcgtgagtgagggtgaaggcggtcaacaccacctgctcgctgacggtcagagcgagccgagttgtcaaaaaaggaaattgtctcgatcatgccgtcgctcgaactgttgaggaagcgggcatcatgctggtaaccaaagtctagtccttcggggaggtcaaatgtcgacttgcggccacccaactgccagatgagagagccatctgagccgttgactttgtacaatgcactcatgtggcggcccgagatgagatagtccccgtcgttgtttttatccacgctgttgatgtggaaatagtcccaggcgtcactggcattgactccagtaaacgcccgcccggaacgaagcgggatgacgctgtctgttgaatccttgtcagaggcggcatatatttggacatcggcaaacaagactcaccagcaggggatgcccagtccagagtgtgtccctcaaaaatcaatttaccggtggcaatgtcgaactcttgaaagatgccgtccgcaatccaattttcctctccagtcccgccgtatggagtcaggtcaattgcggttggttggtaaatctcaaccaaggcagtcttttcgttgacaattttgaattcatgtatcgagatgaggcggtggttgagactttccacgagagcgacgggccggtaatggtcatccaacaaaagtggtgtaccgtaaccatggccgtggaaagggtccagataaccctgaaaagcttgcaacaccggctttccttggtactgcacggcctggaagtttcccacccagccagcatagtaacccaggctcgaccaaaccagatcgccatcattagtgaaaatgtaagcggcagcttgttcaggccccgcacgaacaccgtcaaagccagggtaggggcccacgaagatgtaccctggtgacacgtcatgcgccgcgggaattgtaatattcaatttggggggagcgagatccgggcgggaagcgtactgccagtcggcgtagcaagagccaaccagagcggcgacaagcgcaagtttgttcttgtaaaggctcattttcctgacttttccggatggcaagaattgtcagatcagaactctaagaatgtgaggatggagtgttgaaagacactacttgagaagatttcgaatggcacaaacgaagggttgtttgtctaaaggtactctataatcagcccccgtctcttggatgaggagacaaaccctcaaatcccaacccaccttggcccggaagcggtccgctcatccggcggtaaactgttatacttccgccggatgggatattccccaaggcgaagccgggtccacccacacagcagactaaaggaacagcaatgcaaacttacagggctactatgtacacgctccggcatgggacagtttgcagtgctacgaccgtttgacagcagcatcaaggcaaagcgtctcctcgactcgagctgggcactaatacctatgtgagaccctcgagagtgcaaagacaggaacgcattccagcatgttcttcactagattgattaatgcggcttttatggccatcctggccaacaacatgctgttggcggcggcatcggattgggtcactcagcaacacgctcttaatcccgggcaacctggccaagacaacctagagcagtggacgaagagaagaaagaatgtggtcttaataatgtccgacgatcaagatgcgacgatggaatccatatcttacatgccgaggttgaagcagcacatcatcgataagggtacacactttgccaatcatttcaccacgacggccatctgttgtccgtctagagtgtcgttgtggacaggcaagcagccgcacaacacgaacgttacggacgtggatccgccatatggtaagtatgattcattttccgagtttgtgtgccgagcgggaaaatctaatgagggctcgatcctttttagggggttttccgaaattcatttctcaaggcttgaacgatgcttatttgccagtctggcttcaagagtccggatatgcaacgtactacactgggaaaatgttcaactcacatacagtttggaactaccactcgccattccttaaaggttggaacggcagcaacttcctcctcgatcctggaacatattcatatttgaaccctatctatcagaagaatcacgatcccccaactcagttccacgcacaacatacgaccgagttaatacaaagtcatgcttctgagctcattgatgcagcaataggctcgggcaagcccttcttcgtagcaatcgcccccatcgctccgcattctaatattgacacaaatgatggtggtgacccagtcatgacggaacctattccccttcacagacatcgccacttatttcaggaagcccaggtcccacgtaccgcaaactttaaccccgacaaggcaagcggcgtgagctgggtcgccaatctaccacagttcaacgagaccatggtccgctatcttgaccacttctaccgccaacgccttcgggcccttcagggagtcgacgaactcattgagaaggtcattttgcagctcgatgttgccggcgtcctcgatgacacatacatcatttttacatctgacaatggttatcatattggccagcacaggttgccccccggcaaagaatgcggttttgaggaggacattcgtgtgccactcttcattcgaggacctgggatccgcgagggggccgtcgagaacgcggtcacggcgcacattgacattgcgccaactatattcgacattgcaggcattgagctccgccaagatttcgacggctcgccattgcccaatatcgctagcattgtgccaggccatttctacgagcaggaagacgaccggcaggaacacatcgcagtcgagtattggggcaccgcgatagcagaaggcgaagccggaggattcggtgagtccctgcctgtgtagtgatgacccgctgcccttgctcgcctgtgctttcacaagaactaatatgtgtgaatacttgcagatggtaatggtcaaattgtcatgtctaataacacatacaaggctctgcggattcatagtaaatcacacgatctttattatgccgtttggtgtaacaatgaacacgaactatacgatctcaacgtgagttgtgttgcaccactcagttcatgaaaccatatcaagagcatccttattgacttttgctttatccagaccgacccgcatcagatgcttaatatatatcctgggtatctatcacatatgcgtctgtccccgctcgttagaatcattactcgccttgacgctcttttaatggttctgaagtcttgcaaaggtgagacatgcagaaagccgtggaaggtgctccaccccgatggggatgttatcaacctagacgatgctcttgactcgaaattcgactcattctatcaaacccaagccaaagtatcgttcaccaggtgcgaaccgggctacataatatcgtcggaaggtcctcagactggaaaacaataccgagggggtcttagctggtcacattgggcctaactcagaattctacatcgttcaagtcaagcgcagcggtagtggcctcatccaacccatcatcccacaaactcatgcttacgccttggaggccgtcaaagaactggtctgcggggagaaaaatgccttggtctgtacttattaactacgcaggaggatgagatgttagcgaattgattgcatatgtttgtcgtagccacttacatgactagcgatcccgctttgttcaactgccgtggaatcagacgattccatctcggtgatacgaggcagccgttgtaagttggcgcttctaggtgtttcaggggcgggacaaggggccaacgttggtccgaaggcggaatgtgaaacatcaacgcttccgtccggggcacagaatcttgaaaggtcaaggattgagaagaagctggaaatgtctatgttgatattctcgtcagacttggccatgttattttcatacaatactgccatgtcttgactgaggcgttcaaggctatcagccttggaattgacgtcagtcccaggagttgcctcgtcgagtgtcatggatgttaacttactattcgcaccaaagatggccattttccatgtaagctaaggataaaagcaagacattcttcgtagttttgtttgctttcctgtgctcgtggtgtcttggtgccctggtcgtcgccgacaaagctctgatacagctcgatagtagccactactgcggcacagtaagcaaacatggggtctgacacatagaagcgccttgactgtaggaacttgatgaagtgaacgacccacgaagtgtggtgatctcgttgaaaggtcgtgtgttggagaaaaagttccgatacatgatgctgcccttgtatttgaagcataatcagaattgggtggttgagcatgcagatagaagtgtggtatattaaacggcttagaagccatggagcccaataatcgcgagattcctcaagatcctgcgttgatatgcgggatatgcggatgaaccgatatctgtgcatggacgggagttgcggcccgagattcatgatggactcgactgtcttggagtatgctgactgaggggaccatggtggcatgtcattttcagacgcgcctcggcttcgggtatactcttgaacttgagaccacacctcactaagcttcaagatgacgtagagaataccctcttgctccttggcagacggagaagcagctgcgaactgtccaccttctgttacactccttctagacggagttgtagcactggtagggaattgtggcgaatgcatcgtggcttgcgagagctgactcccagcaactgacacagtttctcccagcagttgctgcaatagaatcacactccagtagcaccgccgccgctcatcgacgatgcgctcatcgccttgatggacaggttcctggtgcaaacgcgcggagtgcaccaacgtcatagccagggaacggtgcactcgcgatagagctatctcgccgtctagcaataggaaatcatattagtaacagtatcggggtccgagaaccatcgatgagttttcaaacttactttgaaagccattgagggtgagcaggcatagggtttgcaatgttgagagctcaacgcgtccagatgctatttgagccatgacgcttcgatgagctgcgtcggcgaacatctgccgctgacctgctgtaggcagtggcgtggtcttggctctatccgagaaccttgagacaagggcaatgacggcgtagacgacttgtgtatcccggtttgcaaaggtcgacacaaagtcttggcggtgaaagagaggcaacggctggcagtcacagtacatcaagaaaagctctgctatggtctcggctgactcccatggaacacgaggatcgtttggtgaggagatggtagatgtggcaccatcagcgcttgatggcgaagcagctgttgacgcgcccgcccccgatgcagtgttgcgcatagagctattggaactgcgtcgacggcgtttctccttccgtttagaccgagagctccatgatgcggacccagcacgatgatctcttaaaccctcaacgacctcggctaatgtaaattctagcgattcgaggcgttcctgctaattggagtgcaagagtcttaatcagtcatcttgacgcagtgcttgaacaatatgctggagagtacttgtagtaaacgtaccagctgtagagacggctgcctttggctctgatgcgaccaggtactgggcatcgcatccttaaaacagtcctgaaacgtggaatccaatggagcatcccctgtcgagccaaatcggggctccatggcgtaggagcatctcacttgcagtctctcgcacgtcgagcagacaggacgctgtcccgagcacttggactttttgcggctatcacaacatcaatcagctggagatgagcagaggcgtgaggaatgatatgcatctgatctgaggatacttgccggcaaggttcacaggcctgccgcgtacgtttcagcggtctctgggtctggggggtgattgcatccatggtcgggtcgggaattggtcaaggcagcccgacaaattcatttacagcgactcaattggaacaaatgatgtcgtcgatttcataacacgactagatgtacggtaccgtctcgttgcctccctcctctttttaagataagcggtgctaccacgtgacttgaaaacaggcttgtattgaagataacatgaaggcaaggtaaatgcggggattatgtggagactttgggcagttaggtactgggatcagggtgtagtagaatgtacatagatttattacctttcattcatgataataaatataactagaagctatagccaagccagcaagtgatatgataatataatattatattaataaatgttccatatatcagagaatatatgtagctactggaatattatagatgtagctagcgatgtactatttaagatacctacataagattcacctttttttgctgtgtctaaatatagggtaactcactgtgcacaagcgtcctcgtttgtactggaaagaacgacgacagacgaacaattgtcctacactcaccaatgtggagattgtcatcatcatcgcccgatccaagtggcccgagcatattgatattaaatggattgattgagttatcacatattgctggcttggtcagccagacaaagtatcatggagtgatccatgtgtcatggtccctcatgtacctgcggcacgcttatgcaaacacggatcacacacggatcacatccgacggatagataagccacaacacattggctagcagtgtgaagatgaagggcaacaccgtcaaagacgtgaattcttcagccccagcacagcccacgcaccaatctcagtggctctaattgtccatgacgagttctgcttgcatataaacaagtttctgtagacgaaatggtgtatatgcccccggctcgctacggcaggcgacttcttcaacactgcctagccgtgcctcgcactcgtccgacacttttctcaaggcatccactcactgcggtcaggagcctttcgacggctgcgaatggccaaagacaagccgcccgcgcccatccctctgtgattgtagctttgctaattgcagtgttcggtagcggagttgctcttggtcaaggtcaaggccgtgaggagcgtgcgccggtcattcactatgcgagcaggcaaaatatgcttgtagtaagctcctcttccgctcagcattgtaccgactacaattcttgaacttaacatgacttttgtgtaggctgccagagagatcgaagcccttcttggagaagactcggtgagctatgacgaagacgacatcgagaaccatggattctcagactggtctagtgtcaactcgacttcgcgagcagtagccgtggtgtatcctagaagcactgacgatgtggtgaaagcggcagaaatctgtcataagctccgcgtccctataggtaggtcgccaacactacctaggccttgccatgtgccccgtatctgatgcgtctctgtgagacagtcccatatggggccggatcctctgtagaaggaaacttttcttcaccctacagtggcatagtcgtcgacgtgacacacatggacaacattctcagcttccatccacaagacatggatgtcgtggtgcagcctggagtgaactgggtggacctgaacaagaagatggagaaagagaaacttttcctccctttggacccctcccctacagcaacagttggtggcatggtgtctacaaactgtagcgggacaaatgcgtttcgatacggaaccatgaaagactgggtaaccaacgtcacagtggttctcgctgatggtcgagtcatcaaaaccaggcagagaccacggaaaacgtctgctggctacaatttgacttccctctttgtgggtgccgagggaactctgggcattatcaccgagatcacccttaaactcgctgtggttcccaatgagacgagcgtcgccgtcgtcacgttccccaccatattttcggcggcgtcggcagcctctaggatcattcgttccggaatccaacttgcagccatggagcttatggacgaagttcaaatgcgtattgtcaaccgccacggaagcgagcaagttcgaaagatgaattgggatgagacaccttccctttttctcaaattctcgagccactccaaagaggggatccagtctgacattcgcggcgtcaaggagctgattgaacaagacgacaacacaaaattcgttttcgccaagaccaaagatgaggaggctaatctttgggcggcgaggaaagaagcgctgtggactatgacttcaattaagcctgaaggccacgccatctggtcgacagacgtcgctgtcccgatctcccggcttgccgagatcatcgaagtgtccaagaaagatggagataaacttggggttttcaccagtatagttggccacgttggcgatggcaacttccacgaagcgttgatgtatgatccaaaagatcccgcacaaagtgccgctgtaaaacatgcggtccaaatgatgataactcgtgctttggaaatggaaggtacggtgtctggcgagcatgctattggaattggaaaaaaggtgagttctttccgtctgttcttgatccatctctgatcttatactaaacaaactgtgaagcaatgcttgatggatgagcttggtctgagcacaattgaagttatgaagcaattgaaaaccgcagttgatccgaggtaagtaaagcgcattgcaagccgtcttttcgcgtctagaatgaagtggtctaaaccataaagaattggtatgcatggattaactgactattctcagatggatcatgaacccgggaaagatttttgacttgccgaaaggatcggccgtccacgcctaatacaggtcgcaccgatgcgaggattttgtgctagaatgttcagaagagggcattttacacatgtagcattcgctcttgtttactcaagtcctagaataattttgatggtccaggtatcaagcacgcctctctttgattccacatctacacgtatgtgcatgattagttggtgtggaaagacaagtcgtcaaatcttgatttcacggggtcattaaaaatcccaacggcgtctaccacaattagagtcgcttccaagcatttgcctgtgtcaaaggccccgggaacgttgtcggtatcaactatattgagctctgatactacaactgtacggtgtcgaataatagcatgccgctatcactaataaaaaatcctttgaaataataactcccaaatatctacataattgtttagttacagtcagtggccacaggtttacgaccatgccgcagtgcactaacagaacacccattacttaattattaaacattccttgatgcgttattttttacttatattaaattgatgaccttgagaaaaagcagcgatgagagaggctaaactcgacaaccttgcttaactatgtacaaaaaactccaagctgttacctttcgctcgtccatacttatccaactgttacctctaaacaaatgtatttccatgtatgttagataccccctgtcagtttagatgggaaactgacttgattgaatgatactaatccagctccccatgatttacaagtataaataatcaccctaattcgtgttgcagcgggtcaacaagcgagtgcagaaggtgcgagccggccctgggccgcatccgacggcactggtccgtttgtgacatctaagacggtggcacgccgccaatataatgaggaatatcgaaggaactacagtaaaagatccccaataagagagacttcacagaaatggcgaatatgactatttcaaatggcaacagcgaaagccattttctgttatctgcagtcccgccgtcagcctttgggggaccttttgcactagaagccgagttccaagccgatttgagtcctagcaaagtcaacttgatcataggggcttatcgagatgatcaggctcgaccatggcagctaagcgccgttgcggaggtatagtctcaaaacttcaaggtattcactagagtgccaagcatactttaactaacttgtctgtgattataggccaaaaaacaattgaaggttgaatcctccttccatgagtacttgcctttacaagggagtagtgagtttatcgaggctgccaagcgactcatttttggggatggtattgtagatgaaatgtgtgaatcgattgcctctatccagacggtctctggaactggggccaatagtctcatagccctattcctagccaagcacactcgttgcagtagtatatggcttccggatccgacttgggtaaaccataaggatatctgggaagtgaatgcgccacgcatcacgacgcgctgctatccctactacaacgactcgatccgggcagttgactttgaccaaatgttgcagactctcaagcatagtgctcaacaaggcgacgcaatccttctccacgcctgtgcgcataatcctactggccaagatcccacagaagcccaatgggacaagattgcgcgcctgtgccaggcgaagaagatgttcgtcatttttgattcagcctatcagggcttcgcttcgggggatttagatcgggacgcttgggcagtgagacacttcactgccttttccgacctcgagatggccgtatgccaatccttttcaaagaatcttggtctttatggggaacgcgtgggtgcgcttcacgtcgtcacgactcgctccccgcccaccgctgctggtcacgtacaaaatcggcttgtcgacctccatcgagcctccgtgtccatggctcctcttttcggctgccgtgtagccaatcagatatttcaaaatcaagaccttcaagacatgtggcaggccgatctcacgactatgagcgggcgaatcagctcgatgcgaaatgcactctatgctgagcttctaaggctacgtacgcctggtgactgggcacatgtcaagaatcaagttggtatgttctcttatacggggttgagcaaggaagaggtaaagctattgcgaacaaaataccatatctatatgcttccttcgggcagggcctcagtctgcggtcttacaaatgcaaatgtcaagtatttggctcaatctattcacaacgtggtaacgggaagcaatggcaacaagacgccaggcaacggagaggatgattagtagttaaaaatgtgataattataagaagacattatgcacagcagacaccgggatgaaagattttgcaaagcatatgtgttctaagaataatacccctagcttagtgttagtataagtgttaggtactttacgaatattctaaatcgccaagagggttctctatcttcaaagagtataacatttttttcaaacacctcagttgcttggggtatcaaacacaaataaatgggcatgagttgactcccgcagcccatgagatgaaattagctatgcgtattacatctagactgtttaggcttgccctagtcaacaagtcaagcaaggcttttgcccagcgagaaccccaaaaacagctcttaacacgaaactctctaggaatgctgccattttcactctcgtagacggaatctttataattatagtcttcaattacaattggcttaaggatgaggtgttgatttgtgcctgtggggtgggaatcggtcatggtcatatatggaacaatcagagcctcaaaaatcttgattctatatacatgtcaacagaaggttaacccctcgaccaaggtgccatcacggttatgtttaacagtgggataactgcactgaacccattgttagctccaagggtcatctaagcattcgcttgttgcgcgatgtggctctgtgtggcttagtggctgtcccaatcaaacttcacgacccgcgagacaggccaggcacagaacaacgtggctcgaccaagcgacataatgtattcccggaccgtagcaggacctgccgtcggatggagagtccaagcacggaagagacgcaacatcttagagctgtcggaagcttgccgtcggatgcggaagccagtaccttatcgaaagcggagacttgtagtgaggagtcgtaaagcaccagagggttataatcttctcagaattttgttcctaacctttctagagccgactattgtttctcgtatcaaatcttgagcagtgtttctggccaaattctcggtcattcctctccatcggtttttgagcaaccccatttattttgactgccagagccttgtgctgtctttggctggcagaaattactgggtagacagaagccaacaacaatgatgcaatttgggcctttcaagcctggcgggagtgtgtctcatgcccaagtttcatatggttcttcgagttcagatgaccaagaccctgaaaacaccgcctccagagtcacacatgacacgtcatccaagactgcccaagttgctgtacatccaacagatcaagagacgcctttattagcaggtcgagtggatagcgaagatggggcgaccgatgagggtagtcagttgacgaagagtgtcatggtgatactccttctcggtagggactgccgcctctttccccccctaaccgccgagggaggatcaaccaatgctaatccaccactcaggcgaattgctttctcacgctgatacaacacttatctttgccgccgcgccacaaatcgcgtcggagctgggtagtcttcgcggcgtcgggtggcttgccacatcatacacactaggtgtatgttcgatgcaacctctctacgggcggctcagcgacatattcggcaggaaacagatgctactgtttgcatatgctgtcctctcggtgggatgcatactttgcggccttagccagagtctcgtacagatcatcgtcgcccgcgccatcagcggcattggtggtgctggcgttatgactatggcatcgatcatcatcactgactcagttccaagaagcaagtttgccacatacaggtcgtacatcaaccttgccacgacgcttgggagaagtatcggtgggcccatcggcggcttcatcgctgactcgatgggttggcactggcttttctggtgtcgtcttcccttctttgcactctcagtcgccctcatactcacttcattgaaggacggaaaagacagtgatgccaagcagacagacgacttggatgaatctctttcgcccacttccttccgccaaaagtgggccaaggttgatgttaaaggggcactgctactgaccaagacgattgtgtccttcatcctgctactcgacacagctgaggaaaatcttggaactccgcagttctggctgcttttggtatcggtacttacgtttggccagctgtttgtatttgtcgagattttcggttccagttcgccaattttcaatctgcggattctggcgaagcgcaacgtcgcactatcgtacctagtcgactacctgcaagtcttctcacaggtcggcatgatgttctctgtgcctttgtactttcaggtaacacagagggcgtctgcagcgaaagccggtgcccacatcgtccctgctgttattgccaacacgatcggcgcccttgcgtcgggcaagatgctgcaagctacgcatcgccacaagattattctggtcttggtcggactacttggagccacctcgtatatcctaatctgggcccgctggaacggcaacaccgacttctgggagtccctgtacgttattgctggcggatttgctacaggtgtagctcagtcagcctcgtttgtcactatgtcgtcgcatctcgaaaagcaagaggtggccatggctacgggtggtttcttccttgcctccagcctaggtacggtcactgctgttacgacagtcaatgtgctccttcagtcatttttcacccgaagactggatgccgtcgtagatatcccgaacaaagcagaggtagggacttgtctaaccttttacaacaatccattgctaaccttcacccccagtttgtcaaaaaagtaacttctgatattgacaaaatatcaaagctgactggagagctgcgcaagcttgtggttggtgcgtttgtgggctcgctcaagaccacatatagtaaggcttcacgaggaataaagagttgaataaagctaacagcatctagtatctggccttgctgcttgccttctttcgtcggtcatcagtgcatttatccgagataaaaagagtcaagaaacttattaaaaagactaagtacatagatcaagcgataacttgacgtacaagatgagcgagtggtcggcccacttgctcatttaggaacaggcacattttattttctggagcccttaattctcttttttttttgacgttctagatttctagatgtagggatttcacgttacatgaaataatttctataaattagactacagaacattgtttggcatgatatagatcctgccttcaaatggggctaagttttctacactctccttacccttgtgggttgtaagaatgagttttggagtctcgccatcaatcaaaagcattgcagattctggaacagcccagtgtttctccaccgagctgaagttaagaacaaccatcatccttctcttccgatcctgcgcctgcttaatgaaaatgtagatatcaaggtcgtccttttcaagacataggtagtctccatacaccagaatatcctcatgctgcttcctaagcaacaacatcttgcgccaaaagccaaacacactatctgggttgtttacttgcgccgcaacgttgatttcatgtgataatggatggggcttcatccaaggctctttgacatccaagccagcccgttcagcttcctcagaaaatccgccatacttggcggcgctgttccatgccataggtatccgtgaatgatcgcgggctagatgttgtagtgctgtaaatcccctgtcgagctcggccttgttattctccccgtggcgttccttgatcatgtcgataaagagacgactactgatgtccaagtagttctccaatgggtatgtctcctttggggcgttgactgcaccaatttcctgcccttgataaatgtactgggttccactgagacaattctgaagaacagccagcattttggctcccgattcccgaagggtggggtggtcatccgtgagccttgagactgatcgcgaaagatcgtggttttccaggaaagcacttgtccaggcgtcagttccctggataagactctgtgccttgccaatagcctctttaaattggggaagagtgtaatttttgggagttgtctcgtatttatgagtacggccccagcctacctcgaccgcgtcaaactggaagaccatgttgagctgtcgcgccgcagcgctcacataaggtaatatccttgccacgtctggggtgtcgagaagctcacccaccgtgatcgcttcgtaacgtgtcaatatgtcgttcatctcgccgatgtactcatgcatccttggtccattacagtatagcatggccgcaggctggaacggtgctgccgggtcagtgaccggggcgtctgggaagtcgaccggtttgctgtacatattgaccgtatcaactcgaaacccatccactccgcggtccagccaaaacaccatggcagatgcatagatggctttcctggcttccgcgctgtcccagttcaaatccggctgctccttggcccacaggtgaaggtaatactccttcgtcgactcatcccactcccatgcgctgccgcccccgaaactgcagcgccagttgttgggtggcagccgttcgccgctctgcgagtattttgctggtcgccagatgtaccaatcccgtttggggttgtctctgctgctcctggcctctttgaaccatgcatgttgatcggaagtgtgattgatgacaagatccatcatgactctcatcccccgagcatgtgtttctctaatcagactttccatatcatcaacgttcccatacggagggtagatggcttcatagttcgatatgtcatatcccatgtccacttgcggactgtcgtaaacggggctaagccatattgtatctgcacctaggctagcgatataatcaagcttggaagcaataccgcggatatcaccaatgccgtcgccattggaatcgcagaaggatgcagggtagatctgatagatgactgcggacttccaccatgttttcacatgagggagaccagccatggtgggttatgaatcttgttggagggaggaatgtaaaggatgactttggaggtacttgctactgagatgcctctttgtctttttaatgtgaaccacatcatgccaagcctgtcaactcactgaaggaaggggagtaggggactggggttgccagtgagaggctgagggtatctagaagatgattggcttaatgtcggcccgagaagccaggcagttaattggctgtttgtcgctccgagatgattgcggggtgatccatttgaggcgcattcagattttcttattggtctattgtcggcccgacatatcttagcgttggcggcaatgtgaggtataatcttccgataagaaatcagaagatcgtgaagtcaacttttccccagcaaaggcctcgaaccatttccacggtatcactttcccacaatggttatctccaccctaatcgccccgtggagaagttcatcctgtggagatagccccatatttcgttatctgaggctgtctgttctcgtgcctcgaagaacgacaagaagtatatatatatgatcgcttccacgcgacctttgcagaagatatcatatcattcaggtcctgaaactcctccagcttagacatcatcaaaccaaccaaccttgccctcttctgagctttgaacacgcttcttcgccatgccctccgccggtgtggaacaaccggtcaacatgtctcatcttaccaatggtgaccacgatgccattgcccaagaggctgttatcgcaaataagaacgaacagagtatgggtcttttcaaatccctcaaactctataggaaagcgtgtttgtggtccatcttcctatccacatgtgtgattatggagggttttgatgtcgtcctcttgaatgctctctacgcctatccacccttccagcgggactttggtgagcgccaaccagatggcagctacgaattagcagccgactggcagtcaggcctttctggaggcaaccaagcagggcagatcatcgggcttctcttgactggacttatcgcagaccgtcttggttaccgcaaaacccttattgcagctttagtgttctgcactggtttcatctttatcgtcttcttttccaagtcgctagttcagcttcttattggagagatcctcattgctatcccttggggcgtttttcaaactacaaccgcaacatacgcctctgaggtctgcccgacccatctccgcgcctacctcacaacctacatcaatgcctgctgggttctgggtcagctcattgcgtccggagtgctccgatctatgctgtcacgagatgacgtgtgggggtacagaatcccatttgctttacagtggatgtggcctgtgcctctcatagtgggcatattcttcgctcctgaatcaccttggtggctcgtccgtcatgatcgtatcgacgaagcaaagcgttcacttgatcgactcaccacaaagcacgaggaaatatcattcaatgccaacgaaacaatctcgatgattatccatacgaacaaggcggagaaggatgcccaggaggggatgtcgcatatggatctgtttagaggcaccaatcttcggcgtaccgaagtagtctgtgtgacatggatgatccaagctgcgaccggctctaccatcacatcatactcgacctatttctaccaacaggccggtatggctgttgagaactctttcaatatgtcgcttggtcagtatggcatgggccttcttggcactattgccgcctggttcatgatgaattggtttgggcgccgaactatttatctttatggtcaaatcgttctcgggatcgttctcctcatcatcggctgtgttggtacagtcggccgagagaatgttgcagcccagtggacaattggcagtctgcttatcgtccacacctttctctacgactgcaccgtgggcccaatctgttattccctcgtgtctgaattatcctcgacccgtcttcggacgaaatcagttgccctcgcacggaacctttacaactgcgtgtgcatcatcaccagcgtcattaccccccgtatgctgaatccaacagcttggaattggggtgccaaaacaggcttcttttgggctggctcctgtatgctgtgtgcaatctggacgtacttccgacttcccgagccaaagggacggacatatctcgagcttgatcttctgtttgagcaaggggtcagtgcccggaagttttcaaccactgtgttgcacactctcgatgggaccgtggaccagatctcggttttgggaaaagtcaatagtgggcttgatgaagataagaaggactaggcagcgatgtaatgcttctttggtagaactaaggtggttcttctttgatcaaggcattgcgctctctactctaattactttaatattttgctattctttggtgtggaataggatcagttgcttgtagatagttgaggagcatatcattctattcaattgttctttaaatcaaaccagggttttccaagtctggagtagctcttcctatatgacagacctagaacgttgtcgtgctagtaggtactcttaacccgacctacaattcatcaataagagaggcgataccaattcgatgcactgagatgatgcactagaaagacttaattgtgatccgttatggattggtaaatttatgagaagaaataggttatcaatgataattcgtggcggctgatggaattcggccgcgggaaattgttgagatatgcgcaagatctagcaccaaggccctccaggcttcttctttaaaacactttgatttatctagttttgcacaatgaattgtcaatctagtatttataccatctaatctatggtggagagtaatgggacccgggactagcatcgataccaccggcgccgtcgatgttgttcaaaacgccttaccaaagtttatcatagtgtacatgcctttcatagcttgcaatttctcaagtaggtaatttctctgctttgaagcaaccgcatcgaaccccgcaagaaatttgaagagaaacagcaaatattctactcttgaaacatcttcgtcttcaatctgcccagattggctggtcaccaccatgacatcagcgatggtgctggttatctcgaagagcttctcaagcattcccatcccgtggaagcccacgctggtgacatcttggagccggctaaatactgatcggaactccgtataaaggctgttgattgggaactggaatgaaagcccctcatgatttgtgggggaagtcgtagaagcaagaaggccttgagacaaggcaagctgccagagcagagtgcgtagccacaacctggtaatcacgaggtcgatatgttgaagttctgtcaaaccactgctccctctgtcctttgataacctttcctcctcagctgtaccagctgcatcttcgtccaaatccctatgcttgttttctatccactgggttgtcagccgcgactccgtagactgtttgagggagtcgttgtgttgtgagcgccagtgtgcaaggaatttatcatccagaatcgcaaatagattgactaggcgacgaaatccgaggttgatgtggcccggtatactcggatcactaactggagggcccgagcttggggccggtaaaacactgccaaaagatggaagaagagctacgtgtctttcatgtagaaacagttcccagtaaagcctttgccatctcgctgcattatctgggccgcctggaaatttttgcccaaaatcaagggcttggaacatggtaataccttcacgtagccaggcaaagctacggtcgacccttcctagtgtcagtgcgcagacacttaagaacacacaggtaagaatgcgttttgcggtcacaggcaacggcttaaggatactgtcatccttttcatcatcccaatcgagttcgtatgctcgatgggctctgatgctgcaccggactaattcagtcatctgcacagcaacacccttatgaagagcccacgatgaccgcatccgattgatggttatagctgcaaaggcatggacaagagcggcatcttcgctactttgatccatgtttctgatggcttcctccatttcttgaggcgagattatcggattcagcgggtacacaaactcggcatattggggaagcaagccaaggaagaaatccgtaggtcgtggcggctcagaccgcgagcctgcctgagggttatgagcttgaggcagacattcgggcccattctcgcccctcctctctcctcgtagctgggcgacaagccagccacgacgcccgcgtccgcgccggcttgttggaggagtcgagaaggtgcatgagagatttaggtgagcacattgcgtgcaaggccacgagccatggcacttgactttgcggaaccggcagccatcacaggcttttgtctttctctggcttgcgtccatctgccaatctgatagtctgcaccaaggggccgcgctctcagatggataccaatcactggttgcacaagggaatttgtggagtgcaggagcgagaatctctacgaagtatgccgggattgtgctccacttactgcggctcaccaaagcctaatcacgtacacgtgttaaaacccctccttaaaacaacctcattttagaagaattagtctattatatatttagctaaattagctgattaatctttatatatgcttaagaaatactattaagattattaattataaaaattaatattttattttataatattatagagtttttttttataattaaataaaataaagtaaaaactagttaggcttaagtataatatataaaaaattaaaggaaataataacttgtataagatatttaagtttattagtaatttttactttatatttacttaatctagttttacttagaattttataggtaattttagctattgcttaaatttttcttttattaaagtaataaaagtcattaaactttagccctagctatatttcaattaatttttgaatacttattcagttagtaaaactattgctatttctacccttgatatttcatctagttaatgccatctaatctgattacactttaacgagatcatctggatatggacaccagccctcatacccagaccaaagaagccggaagacagcccatgaataggtagaagtgtacttcgccactcgtcgaaagtttccccggatttccagaacgttgtagtcgcatacagcgagggcaaaatcccacacatcacagcgacagctgttcaatggttcgttgtctcgccaagtggaatgagcaatgtgagaaacagacatgccggatttgctctccgcccgtacatcggcgccatttcgaatcaagtaaactatcgcgtctgcctgttccttaatgtcgaaccctaaccatctatcattcatgtcccgtagacaccaatgtagacaaccccaaccgtaatcgtcaacagcatgaatattagcaccacgattgagtaagaattcaaaagagtctttgcagcgcctgtgtgaattggacgatgcaagcagcagcggagtcttcccacttgggtctctccactcaacgccagcaaaacctacaccgaaatcaagaaatgttctcatcgaatcctccgagggtttgatgttagtcaaacgaaaaacaggctatgacaatttgtcggtcctacttaccatatgcctcgcagacatgaaggctttagagaatgcagaatgtgtagtatcagattcgtctgtcggatctgcccccgccgcaagcaagatccttctgcattcattagcccgccgcaattcttcttccccataagctccatcatcgtacgtgcaggataagataagagcagattcttcactttcatcgaatctatcgggacaatacacgtctaggtcggcatggttttcgactagatatcggcatatgtgaggttggatatattccgcggcaaactttcacaaacttgtgtgagccctcttgggttaaactttaattgaggatttacttacccaaagaagtggcctccccaactcatcatgatctctcaacgatgccttgccctctcgtaggagagttatgagctcggacaatcgcccctcttcgacgagctggaagactaatgagactcgcgggcggatgtgatttgcttggaaaaaagggattggggagaaaaaacccatgggagaagtttgctgcttgataatcgccgaaaacatcatcccgtcacggacttttggtagaaacgtgagtcttgaagtagtgtatccgatatcgctacgttgtctctttgggattaatccaccatctgcgggatgatgctgaagatatcggcgctttgtgtgcactttcagcgttccatttccaatctcgtacgtttccagacgctgctcgtgtcgagcaacttgattcggccaaggacttctctgagctaaagacaactacttagcaaggtacatccgaatgcagccgtgatagttgatttaatggccattattgggttcctaaattactcaccttggccattgatggacagagtttgggcagagtccaataacccactgacacgccgtagttctttaacactaacacgatccttagactgactcatcacggcccggatgatagtctgcaggtcttcgatgacgctatcgacggcttcttcattcaaaagagaaactctaccaggcgtttactacttactacttgaactgtgattagttcgctgccactcctctcaactgtatcggagaactacacggagtttttccgtgtagccaagcttattagttacagttcacaaagagaaagatcaaaatgaacccagaagatattcaaaagtgactgctgtggtgtttcataagctgctgttagtatgcgacccgaaactccacctcctcctgttcaccgtaaagtagtgccaagtcaccaagccacccaaataagcatgatccacatccgctccgggctccaaagacattcaactcgacaagctgtgcctgctcattctcgtcatcgtagaaaacatcaaatgataagccttgtttaagcaacatcacgtcaagcggctcagcaggctttagttgttgcaagatcctttcatggagagcttggatcgcactgtaaatatcagacgccactctgactttctcgtcttgcagcacattggagaacttccaggccttatgccacctatactggcttattgcagtgattttagcagactcgggtgcacaaaaaacgcgatattctcgctcactacacatgcgttcctgaaacgggaggaaagtaatggccacgtccgaacaaccgtttgacagagatcttcttatgtcattcatcgctctttgtgaagacgatagccggagaataatatccattgttgagagaatcagggattggggtcgccgtcctccatggagtcgacacgttgcatcctttggcgagcagccatcaagccgcatgaaaagcccttctggcgggtatatcagcgatacgaaggttggaaagacttcgtcctggagatcttctgccgcggcacgattgagctggcctgtgaggattgagcttgcagatgagtcgactataacctgcgcctggtgccttgaaaggcgaacaatctgcgcggcagaggagttgaggcctcgcgactccaggataagtggcaaccacctcctaaatgcgtatggtgcttcggatggggctccgatcccctggggcaggctttctgctgagtgaaagcatgtattgaacttggtagtttgcccgtgatcacagtccttctgaactgaatcaatgtcgatttgtgtgagcttcatgccgggcaaatgtaagagctgacgaagaaaacacaaaagtctggtctgtgcaactttttgcgaagacttaatcgcgaacacaagtaattgaagaagtctcaaggaaagcgacagcgactttgtaaagttatgctaaattgattcgactctccaggaagaagggaagacccagattttcatggaatctccgacgaacacacatttaaatgctttaaatcggtggcgcactaaacagttgtacgatgaataaatacttgaaagttcagccctctaaacttagcgaagtgacatgactcattttacttgagtttccaggtacaagctttaggcatcagtaaacatgcccacaattccctatatagaatattcgtaatgtatttgtatcattggtatagtaagaatcatggagctggctgtaaatcttcaaagagttccccgacaaatttccccgcctccagaatactcctgtccgcactccgtggtcctgtcactgtcaggccaattggcagtccgctgtcgcctactaatccaggtacattcaaggcaggggcgtgcaagatagtccacagggtacagaaagcctttgttctcgttagtaacaattattacaacccatcccccttcgtgtggatatgactcaccgagctccccgtccactcaagtcccacaggcgcctcgtcaggcacactgggagtgagaacaaagtcgaattccccggcgatcttgtcccactggttacgaagctggccaatgcagtcgtaggcctcgcagacagcttcaccggaaggatgctctttgctctccacatatttccgaatggaagagtgtagctgctcctttgcctggagatatcctgctctatatgttagccccattcaacaacttcatggcgctgatgccccggagtaacatgttatttacgtgggaggaatgctgctctggcctcgctagatactattgtctctctccagtcgtagcacctattaaatacgttgggtagttcaacatggacgacggttgcccctgcctgctggaggaccctatcagcttgctcccaggcccctcgagtcccgggaccggctttgggccacatgggagacctgatcaaggcgacccggcaagaagaaggccttagcgggggcgggatattcctagagcccggagagatgcggacgatctgtgatagcagggatagatcgtccatgttgcgggtgtaaaagcctagcgtgtcacaggagattgagaatctacctacgccctctgtcgacaaagcaccccaagtcggctatgcgggttgtgctagtcagaacatagatcgatccgatttttcccttcaatgtgagggctgctggttggagaggaccgtagtctactgaccttgagagcaaacgtgcctgtgaacgaccccggcctgatcatgctcccccctgtctgagtcccgacggcaatggggacatgtccatcggccactgcggctgcagagccggatgaagaacctcctggcgtacggctcagatctctggggttccggcaagaacctccgcgcgaggtcgccgcgaactcggtcgtcgccgtcttcccgagaatgatagcgcctgtggatcgtaaaattgagacgatagcagcatcagcgagagccggaccatcatcatcgtgaatcgtagatccgtatcgtgtgggcatgcctaaattaacaatatgagtttttgatgcattttcatattgccctctacagatctgaggaagctagcaagtaccttttacagcaatgatatccttgataccgactggaaccccatgcaacggtcctctctgctcaagggccaactcatcaagggttttggcttgattgatggcccccttggcatctaggaacacccaggcttggatatgaccatcccgctgattgatgtgcgaaagaaggctgagaatatagcgttgcgccgtcatttggccactcctcatcaaacaagaagctttaccggcggataaagagggcagctcggcgtctgtgagcggtttccctctttcatcgtatgccagcgtgggttgtgaccgaggcggtgacagggccgatgcaggaaatccgttgctcactgggacaagagcttcagaggcaagcatgatgtcaatatgggacaaagacaatattgaaacgggttcagagatagcgggcgtgtaaaatgcccaagagctggtccgctgataagagatattcgcaacttttgcgtccaaactgagagtcggcatgatatatgaaacaggaagtctaagcgatggggcgccacttcttattataccgagcaaagaatgcggagtaaaactcatgtccactaatcccgttcaaggtatctcggcgacgttatcgtgggcaacttctaggacgaataacggacatagcccagtcagtggttgttattagcgaggcgagggattacaagcggacttggtattttcttctctacgtaaccgaggactatgtgcagatagttccaaactgcgggcaattagtatagcggcgaatgtaaagctaacagttgattacaatacgagctgctcactagctagatcggcaatatctttgaatcccagcctgcatcccgtctgtttctgcctctccacagcacgctgcagcaccttagcggctctctgcacatgcagcccccagccacgagcatcctccaagaacctcatgatccagtcctggtgaacctcgtcgacagtctcaatgcctgcgagaaatgtcggcagcaccgagaacaccgagtgcgggttgtgcagcttgttcgctttgcccagttggatggtgattttcaggatcttgtgggctgcggactgggcctcatcatcggttcgataacttttgttgcgcatccggctgaggaggatgagtccgcattgggtggtggctttcagattgagccagtggtatgatgttcgagtgatagatatagagttgcccgagtcgaagccttgaagagcaagatcgcattcctgcacaatttcaacgatcagtacatgcagggggaacataggatcctgtctgaggagaaggaaacttgaactcactctttccagctctatcatttcagagtgaaggctctccaaatcatccctgagctcgggggtattttcatgcccgtgcctagcatgttggagaattttaccaaggatagacatgccttcggcaaacttcaaattcacggggtcctgaatcatgtcatcccgtagttctaagctcgggtagctctccccgaaagcctctttgagatacagccggcttctgaggtagagccgaggcaatgactcctgattcccgattattccaatgatggtatcagcctggccacctttgggaagaaataccgaccgtcggaggtccaggtaggccagccagagaagcagccgcgcgctgacgccggtcagtccgctgctgaggagatcccatctttctctgatcaactcccgtatgctgtcgagtcttgacacgaggcctaaaatgttgccggtaacgagatcgcagtggctgaggaaatacgccgttgccaggacgacacccacctgttcctgccgccagtcattcttgcccaccagggatgcagtgagggcgtccatctgggtggatgcttgtgcataatggcctaggtactcgtcggaggcgttctgtccttctagcccatgatgagctgctgcccaggcgatgatgctgctccgtattggtgagtacgtgtttgccttactagaggcgaggaagtgcgagaaaatattccactgggcgttcttgacactgagggtgctggtcatgtatgttttgaagtggcggattgccgatggctctgtgtccgatgggaagaggcttaggcctgcggagagaaactcgggaaggaataattcctcgaggccatcgttggaattttggccatgttccgatgggcttaccgagtttgtgcaaaagcctccgtcatttctgagtctctgtcgtaacatgatttccatcccaggagagtgggagacgtctgactcattttgaagccaggggaacgctgatacctgagagtcaactggtggagtgatggtagatgactcgttggaaagagagatatctccaaggagtggttggttatccggagaaggaggaacagcgtgctccttgggcttctcgcgcaatggctcaggcagcggcatccattcccaatcgtaaggagtattccattcggtagtgacagggcttgttgatacatctagatgcatatcatctttaaacattgacgtatgcggcgtcaacggggattcggcatgaaacgaggatgacttggggctactttggctggccagagttgctgacctcaggttgcttgagaacggcgaaacacaatccagccgtagccggagacatgtcccacaaggatttcctagcccggggcacttcaccttacggcggcgacaagtgaggcatcctgtaaatgtcctcgttcgtttcctcttcaagtatgctgacgaggaagatgatgatgacatgggtgacggtatgaacgatgagggccccttgtcgtgcttgttgatgtaacctccaaggagaaagcaggcggagtcgttcccggactcggaggatgaatctcgatcacggccgctaagccagatttgggggctctcggcgactgccaatcgcgtgtcgagcagcgaaccgtctcctaatctttggattaagttttgttcggtttgcgctcctaaaacagacatcttaacgataacccttgcttggaatgggaactggaagatagacatgcggagttccaatgtatcgaatctttcatgactttggggtacttatctggggtcatgaagataagattgtcgattcttcaacatatatttaagctgacccgagcggcttcaagacatctagagtctatttgctcgctgccttttccacatcacattgttcttccctccgtatccaatccttcttctacaacatctcatcatggccggtggaccgaagaagcccgtcaacatcttcaagcactatgccacagatgctcctaaggagatcttcaactggcggctatggtgcgccatcgtcccctttgccctaatgggcgccgctcgcggcattgacgagggtctgatcaatggcgtcttcacctctcccgccttccaggactaccttggcatcgagaacaaggacccctcggatctggccaatatcaagggcaatgtcgtcgccatggtcaatgtcgggagcatcggaggtgctcttttgtacgaaagcttctgaatctccccctttcaagatgaatagcagcaggctaacgaaccacagtgcctttctaatctgtgaccgcatcggccgagtctgggctacacgcgtactctgcatcctgtggtcgatcggcatcgccatcttcatggccaacaagggccatctaggcgccgtatatgccgggcgacttatcgccggacttggaattggccagacgaccgttgtggctcccgtgtacatcgctgagatcgccccgtcctccgtgcgcggtgcttgtacctgcttcttcactggcgccgtctacatcggcgtgatcattgcgtacgttgccaactacggaacgtctagaagcatgcccaactccattggccgttgggtaagtctcacagcaacatggcaccataaaataaaagtctcccttattgttgttattgtttaacgtcggtgaatccaataaaagtctcccgtctctgactttcgactctttctagctcctcccaacctctgtccacctcatgtttgcaatcatcatctttgccttgtgcttcatcttcacatatgagtcgccccgttacctggtcgccgtcggtcagcgcgaaaaagccctcgtcaacctctgcaagatccgcaacctacccccgaaccacgaatacatagagcgagaaatgtccgacattgaactctccctcgctcacgagaaggaagccactgccggggttggcttcgccggtctcctgaaagagctgttcctgaccccgagcaacttctaccgcatctacatcggcattggcggccagcttctgtcccagtggtccggagggccctccatcaccatctacgcatccaacctctttgcgctcgtcggcgtcaccggcaccgagcagagcctcctttccaccgtcgtcttcggcgtcgtcaagttctgctcctccatgatctgcgccctcttcctcgtcgatatcattggccgcaagaggtcgctcctcatcggcatcgccctacagaccgtttccatggcctacgtggccgctttcctcaccaaagtccctcgcatcgcagaggctgggtaccatccgtccccctctgaagcccgtgccggcaccggcgccattgccttcatctacatctccggcgtcggctgggcgctcggctggaacagcatgcagtatctcctcacggcagagctcttccctctgcgcatccgtgccttgtcgtcgtccctggtgatgtgcacccatttcgccaacgcctacggcaacagccgcgcagtacccaacatgctgctcccgactgcgcaaggtgggttgggtccggccgggacattctggatgttcgcagccatcaccattctcggtgggttctgggtctgggtcacgattcctgagacggcgggacggtcgctggagaccatggacagagtctttggtttgccatggcaccggattggcctcttcggaactcgtgaggctgagcgtatcgattctctagaagcgatagaggatgagaaggtcgtcgtggctaagcacattgaagagaaacgtaacacgactgctgcaagccaatagagccaagagaacggcaagcggctaaaaataaaacatggcacaccaaagcctccaaacagcctcagttttcaacacaataccgaaacaatgaacccagttatcaatataatatcaagttaaataatatagaataatttattattttactattattaattgaaatattattgataagaggatgaggtctctagcttgtacgaaaagagctctggtgtgccatgttttatcttaaccgcttacgcgggtctattgagattagatgcataaatgctcctgatatatttacccatacagagacgtgaatgtgacttggtgatcatgtttagccatgtattgtttttgtactaagtaaaagtgtagagagcctccctacctaaatctaggttgaatgttaagggagatggatggggaatattatatacagtggataaagaagagtcaagagtggtatatagctgagggcctgaaggtaataataatatctatatagccaaatataatctatcatttctaatctatacttaaaagagaagcttttctttcgtcgagacgttctgagctatggaatccggtacacatcaactatcgagggattcttctattctatgtgctgatcgccaattttttcctttccctctcctgcctccaggattgtccccatctccactcgatccaaataagaggggaaaacacaatgaccaccccggccaaaatcaagaacgagtttcgcagcttcagtgcatcaatcatgggttggatggcactaacgccagccgcgcccagaagacaacggcagaggttgttgagggcagtagcgcttgccgatctgtcgggaaagcaatcaatcaacatggtagagttgacgttgaagatcgccgtagatgtgaaagcgatgaagaactgcaggatgagaggagcggcaaggttagaagactgaaagcgatgaatatcgttcaactcaaagctgggtccatacaaggccatcgaaattacgaatgcgatgctgaaatatggtaccatggggagccgcgcgcgctcaaaggggaattctctatccttcttgatgttgactgtgctgactcgtcgttctttcttatactgttcctcaacgcttttaaaactccgatccaacagtcttcctgtagaaagagaccccaggacacatcctaaaccattgggtaggaagcagaggccgatctgccattgagtcaggaatggataccctcttagtaaagctgtcgtcgttgaggaggtcaccatactccatgccgtgtagacaatggcgccccaggataacagtgcggcaatgtctttctggaaaatgtaccctagcggagcgaagatctccttgagagaagggggtgctttggagggctgaagttcctgtttgctcgcaatagcccattctttgggtggctggatccaataggcgagaggcttcttgaatccagaaaggggtatgctcccatttccggctacagtccgttgcgtctcaggtaagaagactagcagaccgagaagtacggaaatactcatgctaaagaggagccaaaagatgcttcggaaaccccaagcactattgaacgcaccaccgatgataggtccaattacctgcccagtcatccttgaaatatcttgtcagcgcatgcatggagccacaagatcaacgtcgatgtaaatctcacctaattcctgcattcgttcccatgaagccaccacgctcattcggatctgccatatcggaaattacgccagcactgatactgatggtggcagcagaccctgcagcttgcagacctcgaagtaccatgagcatgggataattggatgtgaatgccagagccagattggaggctgtgtacacgctcagtgtcaacacgaaggctaaacgccgaccaccagtgtccgagacggcaccgaagatggagggggcgatgccctggacaatcatgtacacggtgatggtcagtgctaccaaggacgcgctgacaccaagttcagtagcgatggtatcgacggcaggaaagtagatatttgacgaaaggggagagaaggaacctgcgagagatacgaggtagaccaagttccatttttggcgtcttgtgaaaatatggtaaggggggctctccgggttgccacgagaaggcgggagctgggctaaaaggacagcatcccgctcctcatcagtgaagtactctatgccattgccaacagttatactactggcagcagcagagggtacagccgaaatcgattgcagtggatgactaccagtctttgggaaatgggtgaagctgacgcccatttttcaataatggcctagaaacttgagtttttggtgcttatggtgtcttttagttgaagagaaaagccttttagcacaggacttccactttccttatatatgagaaagcattgccgttgtctcatggtcaaacgtatcaaccttagtctctcaccctgagtgacatgacaacttcatcgtaaactgcgaagaaacgtcagaaacagggatatacatgcggcatgtggtatcaagtgccgggagggttgtatccgcggcgggcgaggcgcaggggcccgacgcgtaacagccgatcgccgctttgcatctagcagccgacagaccaacgagaggcgagcacggcagccacattctgtacctctggcgcgtatgaaacatggataggtaacatttgaatcatcaaatctgccaatcgccctgcaggtcctttgcgcatgatgtgggtcaaaagcgaggctcagttccagaccaaccacattagcgtacgacgacacaacccgatgattcattttgtgtttggcgtgtccatatatcaagctctctaagcataacttgtcacaggggttttcttgctttctcatacgacggcttcgacgatgtacactagtgacacctgctcctttcaagacgtgatgcaggaagctagtgctcacaattacgtgaacattttctcgactgctacaccagatccatcgccccctcgggaccatttcgcattttagaaggaacttttttcctttctgcggatagtggctatgtatggagggttcctcagctcaaatgcagaagctgccagctgtgtaacccaacggcatcgtgcagaacaggacgtggtcccatcattgggaataatgaccaagataacaacgtaacattcggtctcaaggaacattcttgaagatttctagctacatagaggcttcgtagaagatcttccattcacaactcacggacctaccattacgagttaacacggcataagcgtcgatgctcattaggggaaatccccaccatcataagaagggtattattaggggaaaagcaaaaggaaaaattcaacagattcccaatgcactggcccctcgatatgccggagtcaaggcaccattgcgttgctggggctgtgcctgatcgcgtagaagagccgaagagagcgccaggcaaatggattgtcgtgtcgacaatcctcatggactagaatttatcctctgatctacctactctttctcaccagatgatgatcttttatttttacaagttatttcaaagagaaacggtcatggtttctctcgtgtgtttcgagcaaagttacagtcgtcactacaaacattgctccaccacggcaggccagatcatcacagatcgtcagcgtcgttggcaagcgagagaaaggggaacgtgacccgtacagccaatcgaattctggtgagcgtatggtgctggttaagctacctgaactagaccatgggaaatggtccaggccgacgttttgtggaacaaggggcaggggaacagggacttgatgtgttgtcggagagataagtgcagtgaatcctaagcactcaaatagttacgcagacttgctcggccgagcagaacttctcgccgcgtgtcatatcaaaggggtgttcgtggctggatcgggagctgggagcacaccgagcggtctcacagacgcttgtacatgctcacagggatgtggtatctaacacaagttgtaataaccatcattcgattggctggctggtcttgcccgtttatgatcgtcgacgttctccacatcaggcccgtgctcaggctcggatttccgtttgacgccgagccacagcgtttcagggtcaaactgatctcccaagacctatgattggaggttttatgatatgtggcagcaatcgtgaagattggctcttcgttcatacaagtggttcccgcaaagcatacagcaaaagaggtagagggttctttgggatggtgacagactggatcggcccaatgtcaaatgtgatgtggagacgttgcttccgatagcgcttctcggccccactgataaggagtattagtcagcaatccagcctgagacagactaatctaccctataccttcagtatttccgcatatcacctgcatatcaaagatatcaaacaaatgtttctggaatttaattgatttatttgtgaagcattcctatttaacctgtgacagattcgtttgtttgacgtgacggtctgactggaagcactgtatgcgacggcgatctatacctgtaaccacataaatgaggttgtgggcttggagggtgcctggaaaattatcgatcacaacactaacaaagatagtagtaaatgcactgtgaagttctttttctatttataaactctaattcgaatggattaaatttgcacgtgtatgatatggaagcttccaaaatgatctccctccctcctttttagaggtggctgagttccagcactctggccgggatcccgggtacttactaggtagatgaagacctaaataccctttctactggataagccaatcaagggtcttatcgcaaatgccttcatcatcgctttccttgacgtgccaaccatgttagggatcgaataaacgttcagcgcattcatctgtcagcaggttgtcggaataaaagaccgcgtagccaggaggatgaagacgaatagatgctgcgtttctgctaggttgcaatccactagttattcctatgagacgtctctctaatcgataagttggctcttgaacttcccaaatccctcaatctggggtgttaatgttgtttatttttcaatgcgtggcttcgcgtcaagtgccgggcccatttatctacgcgctctcattagccaattcttttaggcccctgacacaggctgccgtcgcatatctgtgccaatttcatgttcgttgcttcattcaacattagtaaaagagcctccaaaagcgcgcttccaagtggaaaatcagattcatcaatggcctgtttataacatctttggactttttcgatttcatcaatttgcaaggggttgactgggtacgacaatgcatacaaggcattctgtcggcggcgtcagatttgacccccgacccgtttaggtattgttacaagccctgcaggccacccgagttcgactggttgaatttgtgacatcggtgtactcgtccatggctgagagttgcctgttctttgccttgattcttgaaacgtctgttttcgcttctcaagacggcgagggatctcaacgaatgctgagtaagtaattttagcagctcggcgacttaacgtcaagatacctcggtcttttctagacgccattcgaaaagtctatttttttctcaatgcgaccggacctacatttgaaatgcgacatcacgtcagcgacttcggccagaccagtaacctcgttagcagacagacattctgtttccttagtgaagcagggcccagccagtacttgtattcctgcattgagtctcaggcagtgtcattgcacagtttcgatatatgctcctttacatattatttccaattgcttcttcttaatctacaatgtcccaaatacccgaaacgacatcagctatgcaggagctggcacaacaatactccctgtctgctcgaggtgctcagggggtatttgatcgagacatttgggggcctcgcgagaactcgatgggaaatccgtggtcccaaacgaaccctgaagggacgtaagtaggcctctgttcatgtttacttcatggccccttaattgaaaatgctagaatcatcctccgcctggccgagaatagcctcatgcatgatgaagtttcagaatccatcaaacaccaggttagaatctctctccagtcgcaagatgtctcaccttaacatgcacagatgtctgttctccccgtcaatcacttaacctacagcactggacctagaggatcccgtcgtcttcgttccacgctggcggagttcttcaaggaggaatttggggctcgcgaacctatgggggttgacaacatatccattacgccggggttggccagcgcaatagattcgttgagttgggccatatgtgacgaaggggatgcaatcctcattccacaaccgctctataacggtttcaacttcgacctgttgaatcgtagcggtgtccggatcgtcggagtaccatatactggaattaagggattttcggtacttgacgacctcttcaacgccgaggtaaaccagctagccatcgaagcagcacttgagaaagcacatcgggacggggtccgagtcaaagccctcctaatttcccagtaagccaaatttgccaaggtagaaagcgacgatactgacattttctagccctcacaaccctttaggacgatgctacgttggtttcctctttgatcactgttctaccagagctaattgcggccacagccagtcgaaactttgattgcattcgcctcaatctgcagtcaacatggtctacatttcatttccgacgaaatttatggaaagtcgatctttcaaaatccggcaattccggacgccaccccctttctgtcaacgttgtccctcgatcttcaaggtatcattgaccaaaaccggcatcatgtactatatggtgcaagcaaggatttctgcgccaatggactccgtctaggagttgtgtgtacccgaaataagggaatcataggagctatctccagcatcaggtgcgtacgacccaatacatcaatgaagtttgatgtatctgacgagacttgggattagcatgttttcttggtctccacatctcattcaggacatgtgggcagctatgcttgaagaccgcacatggctcaaaggcttcctagagacaaaattaatgctcatgaaggagaattatcaaatagcaacatcattttgtcgtgaccacggcattccgttttacgaagcgtaagtggcacgaaaatctcaccgttcattagctaacaaacgaaagcaacgcgggcctattcctatggctggatctccggcatctgcttctatcgcatgcaacatctaaaggggatggggataatgtgttggccacaaagccccctaatgcgaaggtgcttcaagagcgcgagaacgaaataatagatctgtgcctacgaaacggcgtgatgatagcaccaggtcatgtttacatgccagaggagcatggctggtttcgaatgacttttactgtaaaagaggatgctttgcaagaaggtttagctagattgtcgaggtctttgcaagaagccggtgctcagacggctagtcacagcatctagtagaacttgactcatggtatatgcgcaaagaagagacggccttagcattgagccttcattgaaaatgttcatctataaaggcttctttaacataatggattgattgaagccatctagcggcataccaagtaggttggactagatttcatcattcagagcttattgctttcaaatcctcacaattttcgggtctagcacagcaatgctactcaccactcccctaaattgagcttacctatagcaatttcttggacatggcaggagatgtataattattacttggctagattctatcagccatttgatgacctatcctttcctaggtaacatacatgtttgagcgtctgaccttacagacactattatagctaatgatagtgacaactttcctatgtcagtagatagaaatatcatgatagtttggattatgcggtcttatttgaaaatcaaaattgatcatcacacgatttctcttagttcgcagattccacacctgactagttatactactcacgactaaacgtgacaatctgaccttctggttataacgtagctaagtcatgttgtactaaatcagtgtgagctggtggcgtaggattcaacagagaatatcgccgaacgagaagagttgtatggttgctccgcatacgagagttataactcccatcacgctgcagacagttgtgagattttctttactggagatagaggaagcgcagagtatggcaccaaccactcctgctactccccaggccaccaaaaccgagccgtagctatacgcgaaggcggcgggttgtgagtgataacgtttgatgaggccaggcagtatcccaaaacccatgccgtgtgcaaagagaatagaaaggagagtgattgtagcttgcagaccgctcgggtactgtgctagcctcagaagcatagctccacggagaatgaatagcacagagaaactggctcgcgcaccgagccacccttgaaatgactgtgcaagtaggccaccgagtgcaagagcaaccatgatgagaggcaagattagagcggtatactgatggtcgggctcgctgtataggtttgccagtggtagtatcccagcaaatgccgtcatgcccggcagagcattgaagaaaagcagtgttcgaaacgctcttcttgggctagccaccttttgttccgagtccggtgatcccgtgaattgggtgaggtcgttgggcaacgcaatcatcgtacaaagggcaactggaatggagatgtagcctgatagacgaacgaggtgcccgagactttgctggtctatcgaactgaaagagaagtacgagtatgaacctatgcacgctcccgcaccagtagaaaatcccaaggggccaatagcactcctcgccagcggtcgttgcggaaatccctgtccgaccaggacgatgactgatagataggtgtagcccactccgattcctccaaacgcaacggcgatcaatatgcctacgaaattcgacatggctagtgcatgtccagtgcctatcagcgccagaccccaaattgcggttccactggcagctgtagcacgagcacccaaggtcgatagtagagacgcgcatgtgcccagcccgaaggagagtccgaagcaagctgaagcaaagggtgcaaatgatgactgctgaggcatatccaggagcctaggaaattccgattgtatagtgctgagggcgtacgcaccgccgacacaaaacatgtttgcggtgctcgctagtgccagggtcgatggacgagccgctggatgatatgaagaacgtgatgcttctgtcatcgtgatggtgtcgatgaatgcaattgtgattggatagcccttttgttgctggttcttctggaagacgctgttcgtactgaacggcatgcgatctgaggcaacaatattctgcagattttcgaagctgtatgaaatcaaatacctccctggctgaaccgagctcacgcgctgagcccatttagccaggctttatctagttcgtgacaatgacgttaacgaaagaggtggtgctcacattggacgctacccacccccactcgaaaatctatcacggtggactatgttactgggacgccttgccgcttggcgggagtcattccgcctcaaagtcgatacgaagtacgctctgttggtaggcatactgattagtgtcgagtaatctctagagctgttgtgagttgtatatctgatctgaatgaggaggcgtggagggagctccgcaacagccgccaatgccggcggtaatatctaaacctgccgctgtctatcttattgtcacctgaagtggggggggagagactaggaaagtcttagcatttgcgcgaacgttatgctgaagaatcttcggggccatccctctacgcctagcgttattgtagtcgtggctgtggcgggagaggcggaaacacttcccgccaacagaaagttgcgagtcattcctacggcccaaggcgatgcaagattggcaataccgtccccaatgtcttatctcctaccccgccctagccccagccccagtctcccttgattcctaggaactgtatgtgtggagagaaggtcatctccttcgataactgagggcccagtgggtgtacggcatcttgcttaaattcaaggcgtttgcctcgatgttcaagcaatatgttatctacaaccttggattcttccgccgtcattcgcatcatagtccagtagttgcctaacatgtcgcctctcactcgcctcccaggctccctcaccagcttgaagctgaactggaccacagcccttgtcgtgtctgtctgcgttgtggactctgtgacaatcgcgtacgatgggtctctgatgggctccctcaatgtgatggagacctatcacaactacttccaacttacgactacgacgacggccatcaacacctgtgcaacattcttgggtgctatcttggttgggccgtttaccggcatcttgattgacaggaacggtaggaagagtggcttatgggcagctgtcgccataaacattctcggagccgtcctggccggctccgcgatcaacgtcgctatgttcatagccgcgcgcattgtcatcggtgtcggtgtaggtttggggcagacagccgcaagtacatacgttgctgagacgacggctccgagaatcagatcctttgctcttggcctctacttttcctgctgggcggttggcgcactgcttgctgcaggagtatcgtacggggtaggtgatgttgctaagattaactctcttggtgtctcaaagcatcattgatccttccagggatagctaaaatttaatagtgttcaacgctcgaaccctcgaacgcatcctggcgaatcccatcatacctacagggagccatgccgcttctcatagttccactcctgtattatatccccgaatcgcctcgatggctagcgttccgcgaccgccgggaagaagcgttggcaatcatttcgaaaatcaacggcaagcccgaggatgatgaagatgtacaactgcagttccaggagattgttgcatcgctcaaccacgaaaaggcccagtctatgagtctcaaagccattgtacgcaagccaaacagaaggcgcttgcttctcgcgctctctgtcgcaccccttgccatgctcacagggtcaaacgttataacgtgagtcaaacctccttgagccttggtcaacttagatgcttacttgccatcaacaggtactacttcggaagtatgctgacacaagccggcattggaaaccctacgacgcagcttcaaatcaacgtagttctttcttcgtggcaacttgtggtggccatcaccggctctagtctcgcagaaaagcttggccgtcgtttcttggcccttttcagtctcgggacatgttctgcgttcttctatatcctcgcaggattgacggccaagtatgggactgccggggacaaagcaggcacgtatggcacagtggcttgcatcttccttttccttggagcatacgcgttcggtattacccctctcacggccatgtatgcccccgaggtcctgtcgtacaacatgcgcgccaatggaatcgcgatgcagggcattctcatcaagtcgtgtggagtattggtcacgctcgcctttccatacatgctcgaaagcatcggctggaagtcgtatattatcaacgcttcgtggaacattcttctatggctatacatttggtttcagtgggtggaaacgaagggactcacacttgaagaggtagacagaatttttgatggcgaagtgcttgttggggcgcctgtggaatctgctgagaaaggggaggtggttatgtcagaggtcaaggagacatgacggggaacatcacggggggggtaacaaatctcgtccctatcagaacgtagtttctacgtgctgctcatttacttagttcctgtttgatcattgataattgaaagctggtgcctagcattggacgcctcctttttgaagcggtgcctaatcttcaggcccagttaaagcatttcgcatataatctgattggtgctaagaggacaaggctccgatagcccaacaagccagagatgcaagaagatgaaacggacctacgcgatattgaactggtccttcttcgcccacgtaaactgcaaacttggttagtcgaggtgtttgtagggctctccatcatagtgccatggccatatattcactcccacgcacattcgtctacggcatttactacgacaaggcaacgtgcacagctcgcggtatctttgccgcacactacttcacgcccgtcatgtcttcaatgcctaccttatattaggctggctatccccagttgctggcggttagggcggagtgtttgccgctcatccccacacagtcgaaggcggcgctttggagtgcgctctccgctggcgggaattgcacgagtcattgccgcctggcaaaaatcccatctagtctattccagaaaccggaaatgatatgtctatcaccttgggtaggcggcgtagagagcctcgggacctgttgcacccgggaatcccagatatgcttaagaagccttcgcaggccatcattcgacctgcaggccagtctgtgataaggcagctctccattttgaaacagtaattctttaaactctctttgatcatggcaccccacgcgacagacgagaccggttcgggtcatctcgttgacaattccacaagtcacaagcagtctaccattgcccaattgatagatgccctctctctggacgagaaatgcaatctgctctcgggggcgaatatgtgggaaacgcacgccattccacgcctcggaatccgatccctcaagacgacggacgggcccgctggagtgagaggttcaaggtggacggatgggacgcacacaacgcagatcccctgtggtatctctctcggtgcaacgttcaaccccgaggttgtccgtcgtgttgggaagattttgggttcagagaccaagagaaagagggcgcacgtgcttctggcgcccaccatgaatatatctagatctccgtttggcggccgcaatttcgagaactttggcgaagaccccttattgactggtactttggcgagcgcgtacattgacggtgtccaaagcgaagatgtgggcgcttgtatgaaacactatgttgccaacgaccaagaaacaaggagattcaacatggatgagaagatcgacgagcgtactcttcgggaaatttacttgaagccctttcacatggcattgtctgtgaatccctggacagcaatgacggcataccccaaggtcaacggggagcacgtggacatgagtcaacatctagtgaagaacatccttcgtgaggaatggggttacaacaacctggcgatgagcgactggggaggtctcaacgacacggttaagagcatcttggccaccacagacctggagatgcccggaccaccaatgagatacggacgagctctaaaggacgcagttctcaatggcgacgtatccgagaagtgtcatatcaacccctcggtggagcgcctgctaaagcttctggccaaggcagggaggctgcagagtcctggagctgccgtgaccgaggaggattcaagcgaagctaacaggtgtgaagaaggcgaggaggaattcgacgatccaaagacccgccaaacagtcagggaagctgcgggagagggcatcgttcttctcaaaaacgattccggcacactgcctctagcaccagccaagctgaagaggcttgccatcattggtccgaacgctaagtatccgaccactggcgggacgggaagtgccatcgtgaatccatactatgtcactaacccttaccagtccatcgcggatgcttctagaagcataaatcctgacttggaagtgctctatgagcgaggcatcctcactcatttgcagccccccttattgggcgactgcctcgtagccccaaacaccaaacagccagggatgcaggtcgagttcttcgacagcgatagattcgagggccctgtagttgccacgacaaattggcacgattctctcgtgtactttatgagcgacggggacgttccgctttccctccgaggcaccaaatacacctacagagcaacgggcattctccggcccagtgttactggtacatacgatttcagtttctcgagtacgggcaaggccaagcttttcatcgacggggatctgatcatcgacaacacggaatggacacaaatcagcggaaatttcatgaattgcggcagcgtcgagcagttttcaagtcgcgagcttgaagctggcaagtcgtatgttgtgtccgtggacaacttggtcgtcccaccccctactcctgcccacgataacactctcttccacaagatatctggcgtccgcataggaatgctctaccaacatgatacggacgccatgtttagaaacgctgttgccgcagcaagctctgctgacgccgccatagttgtggtaggacacaacaacgatacagaacgcgaggggtcagaccgcacatcgcttgccctacccgggcgcaccgatgagctcatccgggcagtctgcgccgtcaacaaacacgtcgttgtcgtcacacagtcagcgtgtgccatttccatgccttgggcggcggaacccgccgccatcgttcacgcgtggtaccagggacaagagtgtggaaacgcaatagccgacgtgatcctgggcgccgtgaatccttccgggaagctacccgtgtcatttccaaaccgcatagaggatcacggctcatataagtggttcccaggcgacgcggcgtcggatcaagcacactatggcgaaggcgtgttggtgggatatcggtggtttgacgccaagggactggagcctctgtggcccttcggatttgggttgagttacacatcctttgcgatctcgaatatatcgacccaaggcggtattgatgctagtggctctggaactattcttatcacaatgacggtcatgaacgtcggcagggtaaaagggaccgaagtcattcaggtgtatacttccccctcgcctgttttgaaggcgattggtctatcagcatctccaaagtccctagcctcttttgtcaagatcggtcttgatgtgggagagtccagagaggtacaaattccagtggaaggagactcttttgcctggtacgatgccgaagatactggcatggccagacgggggtggagggtggatcctggcgtgtacacctgtttcataggcacaagctcccgtcacattgtgtcagaggtgagcatcttaatagagtgatgtaggctatttgagcattctatactttgccttgaccgcatatacaatacagagcatcgcctcaatgctagacccattagctgtccaattctcaaagattaagatagtatcatcctgtagctgtgctattccatctaccaacctagtcagctcagggcagagcgaagcctttgttaaaaggagaatgcatgctagtgcacttcagtggctagtgttagcagtcatcgcaccctgggtaaaagagattgcaaacctacgagtggaggaagatttccaaggaggcagaaggttgccttaaacgcactgcaacagtattgatatactgctgacagtgggttaggcactcgcttgcattggagagtgtctgctgtgggatcgcctgtcccagagaagacaagtgaaacgcacgcagcaagaagggccggaagatgatgtctcccgcagcatggtagcgcatctttagcacagcctgctcgatcgtcatgttctcaagaatagcaggcggcttgatagactctggtagaagcgtgaaccattcacgcagctggtgtgcgagctcatgggagatgcgaaaggaaggatcactgccttcgagagactctttcggcaaggtctgcttgcgacattggtcgtacagtgcattgtggatacgatttagcagtttgcgagaagagatgttcgctagccaagagagcatgtgaggatccgcgggagtaccgcaatctgggaaaggcatgtcttctacaagttgctccaccccactccttggtaaatggtgctcagctagcgtatcactgttgggattgtcggtgagctttctatgttggtcttcggtctggtctgctgtgaagtaagcttaccattccaagatgaacacggcccagcagagccgagtaagtgcaggcgttggggttgtcctgaatcaccattagccgagtcagctagctggctattacgtgacgcagaaacagaccataggagtatctgttgggtgctggtggatgccatgtgcactagtcgccatgtttgaaggggtcgagacaggtagccaaagtaaagcgaggcgaggtacatggcttgtggtagaacgatatcagcgccgaaaaacataggccactcgtcgacgaggtgtctaagagcgggctcaaagaaatcgattccaggtggcgcatcctcggaaacatccctaaagcttgaaacctgagctatggcaccgagtgccagaaccacaaacacaaggcagacagagtgagtaatggcgagtataccctcggcgactactttgtcgtatactaacataaactcactacgatctaatactggatgctgtgttccaacgaggttgaaataggcctcaatgagctgccgcgtttgccaacgtgagacatcgggcaaacccgccctactgtgtttccccgcctcaccaagggacagcctttcaggcacattccgcttgacttcgacacgagagagggcaaaaggaggatagtctccaacaagcaacctgatggactcggaacgcagtagatctccggttgttgtagaatgcgcgatcgggatcgtcatggcggcactggtactgtccgacgactctggttggatcgcaatgtgcggatgtaatgccgcctggggagaaggagaagggacagtggcggcgacgttgatcctcccagcttctggggatacaccagcgaaagacaacccggcgttgctaacagctggcgagtaggcttgaagccacccagcaccgggactggcatgatgttgactagcagcagtcgttgcggtttcgctagaaccaaagtttgcaacgattcgctcaaggttctcaagcctgtctaggatgatagatgtgtgctcatcgttgtgtccgccgcttgtcctacacgataatctgttaaagcgcatacattgacgttgaatcgtggcacatacttggatgcctgctcttggtagacgcatcgtgaatcattagattcctcacagagactacataccggctgtcgcccatcacattttcgttttctatagcggccaggtgcttgtcagaattgctcacaatgcagtacttgcaactgggattttcgacggcatgatgcacgtcagctaggattttggcctaccgtttgcgacagtagttacaggcaatggcagcacgccgtttcgcaggaggatccatgcgctttgcgttattgtagacccagcggcggcttgggcggagagcaagttgaagctcaagtggacgagggagaaccgtgggaagtgttgagaaagtggtcggtgcagactgacgtctggccccagagtggatcaagttagcggcggaatggcggctccgttgccgctgtatgtagtttgccatgactcgtagaatcttaactgctttactggggcaaaggggaggggagactgggtcggattagatcatgggcgtgcgaaccctgtccaggtgcatgccatagttctttcgcagaattcgcttgggcactatgccggcgagagacatggcattaaggaagttctggaacattggtgcattggtttcgattaggcccttggctgcctctgggctcatgggatccagcaccgatttcggttgaaggtaggcatagtagaatagatacccggcctttacctgagcttgttgcaagttctctgcaattgattctgcagcacatgtgtgtcccgggagagttgttcgttattaaagaatgacttggccccttcagtgagaggagacctcgaaacgatgaagatgcgtgactagcgaggtgtgtcaagcaaagccctcaaggaaggcgtgaaaccccgagatgccactggcaccgcatataatggcagtcaatccaccaacttcaggccaaactgggggaggttgcggaacagtccgctgttgcgtaagggctgcaaacgtgatgacatgttgctgagaataattggcgggtggtttcttcttgcaaaaggttgataagacttttgtctacggtaatttgtctactgttgcacttcgccacgacacaaatgatgcatctcaagttacccaaccttgtgcatctcactcggcgtcactgcgcgctaacaaacaaccttacacagctcaaccagcgcgagattgtgattggcgagcaaagatttccgagacactcgtcaatgagcaccttcaaatacatgacatcattgcctgagccgcgatcggctggggtggagcgagatagatttcattatttgtgcaacttccgaggcgggacgactcacgttttgcccaagaggatgttagagacaacttgaccttcctgacatatttcggtacccatgatatcggcagtgactttttgcaattggcaagtgatattggccaaggatttagttgacggttgcttatatcagacctttcgggatctcacattagctcagcatgtctaggcatttcattccatctagctagctcgttgtctgatttcattacgtcgtagtactgacaggtgatcatcatgggggttctcctaaatagtacagggatcttttgaagtatgataagacacctggtgcaagtatacgccccttcgcccaccactatagagcctaaagcgcaacatggatgcgggattcggcttcactttggtcgacagagccctagatctcaaatgttgggtttaactccctgtagcaaggctcgccttgattaggtcggctgccttctccgccaatgcatacactgcagcgctggtatggccgcttataaggtgtggtatgactgaagcatctacaacacgcacatttgccgttccatagaccttcagtgttgggtcaatcacacctcccaactctcggggcagcattgaacaagtcccgatggtgtgagatgccggcatacctttgtaatttattccattagcatgactatcgtggaggaagccatatgtatagatcattatgggctctccacttacaagagctggttagaaactctgcccattgcgaatctgtcgcgttctctggtagcactgcatctccagggacaatgagatcgccaacaaggtcgctcaatggcttggtggacattatctttcgtgctatacggccgacttccagagcgacgtgcttgtcataatcaatggataaaaagttgggatctacagctgggttgttaatctccccggcggcattgaggtgagcacttccccaagagaacggcaacgtgggtgagaacacgatgccgatgacgctgcccacggagaagaattcaaattccaccacgctcgacttcttatcgaagatcacgtcatgttggatctcgaaccttttcttcaaagcttcggccgacacccccccattgagcctctttgcgatcatctccgaccaagacgctagcttttctttggtagccgcgtcgacggtatcggtagtagccttgaatacgtcttgagccgtagcaaaggctgcaaaagggacttggccgacgagccccggggtggcttggaacatgagtacccagagaggctggtcttgaagcgcctcgccaaccgccggaagctcaactttggtcgggatgccattgcgggccagaatgctgggatctacgttagcatcatccctgcggtggttcgctgctacgtacctaggattcccgattcctgaggcctcgaggatgagtggtgagacatatgttcctgtggaaatgatgacctccttcgtagccgctacggacgccaaatgaccttgatcatccgtgtactcgagtccagtggcaacgaccttgccgccctcgccggcgattgaaaatatgatccgcttcacagccccttggatgaccttgaggttccgtctgtggtcaattggttcatagtaggcgcgggcagcgctttcacggatgtttgcgtctcgatccatggttttaggatatgcaccgaacccgcggttgttcccaccattcacatctagattcaggctgaagcccagctcctcgcaagtctctcgagccgagtggtaaaaggtgccgttttccacttggaacgggtgcccggtattgagcggaccatcctccccgtgatactccgcgacatgagtcatcccggcctcgcgctgggccttggtcgggatggcgaactgctccgagcggatgaagtacgggagcagcgtgtcccagttccatcccgggttgccgagccgttcccaggcatcgtactcggctttgtttcctcgaatatagtacaatcctaagcaagacgtgtgtgagtcgttaagaataagatcaagcttcatcggccggcataccgtttatgactgtggtgccgccaagggctttgcctgcgggatgatcaatgaccctgtcgcctagctgaggctgagctatggatttgaacttccaatccaagtcggggctgtaggtaatgccagccaagtctacgttgagaacgccggcatcgtcgcgcacatcgcggcctggctcgacgacggcgacgttaatgctgggattctcagacaagcggttggcaatgacgagccctgcctgtcctccgccggcgataacgtagtcgaaagccattcctagctgacacgcaaaggtgtgggcacgagccagaacagacgagttatgggtctggaatggtgaaagtgaagagctatctctgcggcagatcgacggacgcaggctgggttgcaccgaagagcagagataagctgcagtggcgaagcagcgtgcctttgtactgatgaactgcgttggcgcttgtacatgcacgctcccaatccttgtagcttttcattctactgatgcatgcaaggtgagaccttggcaggcttggtaaaccaacaatggaaaacgacatgggcctgtctgcatattaatgtcagataaccgagagtagccagcccaagtaagggccaatatgcgctgaaaccgtcagcttacacagtctaagatttgacgagcccatgttgccaaggacggacaaagatacatcttgactctataatacacagatacaaagtcatctagtctcgaagcatatttgattactattgttatggtgtatggaaacaaaaaaaaacctgggggaacccaggcagctagaaagaataattactattatatgtatatgcaacgtgtatatgcagttttcagtaggctggcagaggcattatacagtttccgactcgttagttccctcgctactcagagaatctgcccctctctttgttttcgggcctctactctggctggagtactgagcgttaacttgcacggagtaaggcgcgctctgatcaatcagcatgtccgtgtcgttgttgaatccgttaggcgactttggtgcttgcttccccctctccatggtgttcatctcgatggtggtcgttacggttggccagcttttcgagtccatgttgcctgcccttgaggtcaccaatgtctctcctttgctctgggtacccagtccatgtgaacgttggttgtagcctgagctgccttggaggtgctccgagtttcgggcaatcttggcgatcagtgtagccatggacatttcgatgttgagtttgacaatgtaggcgagggggtgaaattgcatatagctattagagcgacatagaacgttagctgtcagatttcgcggggcaagctgtgctaagagagcgatatgaggatggccacgtacacgaaactgttcttaagactcatcatggccacgatgaggacatccattcccaatgaaaatccgataatgaacatgttgaacttgacgagattgttatacttatggagaccgttttcgaccaggttttgtttcacaatccggataaaaaatatgttcaaagcggcatcgacaagaaggtaaatcaccttttcacagcgatcccagatctcattgatgtgaacatactcatccgatatctgtagacgagctgggatccagatgcagtagactgagatgttgatggcggtgattaggccggctgtcccccatttgactctccacagtagtctctgatcggtgagaagaattccgcatcggttcacgataatctgaagaaggaattggacctgatgcgtgttagaactcgctcttttcggggaagtgtcgagacatggaagcacatacttgaagtgcccaaagcgtgactggtaatcaaaaggttagctacgactggtatgagatagccacagcttccactgctagagtaagtggagacagggagagacactcacggatacagaaaaagaaggcaaagctgtacgttgaatgattatcagcagggtccatagagtgatgtgctgttccaggggtaacccatacctaggtggaataactcccattatgttcatgaagcaaataatcccaaagctgagacacacggtgatctcgccccaaatcatccaaacatatgcattactgagcatggaccagccacgccggcggtaggcatttgcggtctgtcgtatcgcggtccatgtcgtcaaccatccaatgccgagggtgaagccccacgcgacggaagcaataactagatcagccgatgtcacgacctccggtttatagcggtcgggtattaaggttatcattcttcgttaggtacgaccgtgaagaatcggtcggtgaggctcggtgaatgcggtcagtactaaagagcaagaaggaatggaaggtctagaagacaggtgtaacgcaaatggcaagctgggtcaggtatatgcaaagccaccgagacatgggaggacgcaagacattgatcttttgaagaaaaccgccacttgaagactgggcgtcaacaaaaggagagtgcaatttctttgctagcgcattattgcccaatgacaaacatctgatccccctccgtattcacctagtaagatatatcgggcttctcccgctagtgtgtctctcggcatcagacgcggtttggactagtaacgaataggaagtaaagttctccaacacgttatgccggacactgttccgctagctctgatttttctctcagcccctcgatctagctctcaggtacagcatagtttgcggcgcaaacctcccgaaagggttacaaggagtccaaaactaacgcgtttgggctttttgtctgcaacctcatcaagatgatcaaaaccgggctttatccggtgccaatgcaatgattcagatggacctttctcacgtggcttttagggttggtttgacccttgaggatggttgtgcgattcaggaatggggactcgcgttgtcctagaccaatttcctatacttcttggttctttgggggattccttgttgcctcccccgaaaatcttcggtgttacggtggtcagcttgccgttcgcgaatctacagcctctgtttgcatggcagcgaaatgaaaggacataggcctcggttagaacttgaccgagtcaagacacaccgcgtgagatgtgccgagcctggatagcgtaatccttcctgtactagtggcgctcgagttgacatggactcgcccgctccccctcctcgtcccaaaccatagcttcggagtttgtggagaagaccagtggctaccctggccccctattttagcacgtttagcagttgtttttgctccgcttccaagtctgtttgtttggtcacacaaatttcacccaacttcaggtgttcgccaccaggcttggccttcacggagataggatgcgcgtggctttgatattacatgagcttctcaatatggtatggttctgttagaggatgtccgctcagtatcactcaacagttctagtataccttgactaagacccggctgcattctgtgtgatagaagtatctacacaatcaagaaacccaagacgctagagaaataagagtacgaatcacaaaggttttcccgaggagcttccagagagtgagatggtagggacccagggagggagcccgtatgggcggggatagattaggcaaggcatctaagtggcgaggctagtcattcgcatcctaaaaaatttcccggctactgcactggtgacaactcgcaccgtcgatcgtttttagctacagtgagcccataagctcagtgccaagggtctaactctaggtctaactctaggtaccgtactgctagttcaaaatctcaacgtgattcctcatgaaggccacgttagctagcggggttactgagggaaataaatcatacccaagcgaggcaacttgaagcccaacggtgaaggagattgagagttgaaagataatcattgatcgacaatcacgactcctcagccggaatttcggcacgaagatagtggccatgctggatgcagcccgatgggaaatgcgcaacatttcaatagtctggggggattggcacggaacacggaggatgttcccctttccctaccgcctctgttaccaggaaccaggactacggtagcttcgataccacatcatgcgccaaacttgctagggacttcttactctttgtcaagctaaaaagtggcacatcagccccaaatgcactccataaccaattccggaattccgatatcagcaaactgtccacaccctactgatgggttgacctgtttgaatccatctccttgatacgcaagagaaccatacttgacagtttttggagatgactctcgaaataacctcttgcaacgacccacaaactgcctcttctctcagagtatcaatggcaggctttgaaattgatttgatctaagttggaagtgagccgagggcagattcgccgttgctcgccgactggttctcctccttgatccgactggacagcgtggacactggacaggacgatggccgagcgagggtcccaccggctttcaaactccacttcgaatccttgcccatatgtacaattgccggagccgcgtggtttccatccctgttgggagctccgatttctgtggatgccagtgcaaatcattgaccaggcagagatcaatcatttgaagcatctcatcttcaccgaagtgccctgacccccctgcggagcaaccggttcatcacatcactgttctagggcacgtaacccacatcagagatgactcccagagcgattgccactgatggctttccctgtattttgcgccactgggcgaatgtatcaagaactggttagccgcgcagtagttgctttcagtggtactttcatgagatccagacagaggcgacgtgaggaagaagtcattttcatggatctcgaggggggtatgcaagttccaggtgccttgccatttgggctggattcccttatgccaggcttcgttgctcacttatggaaagaaaaaggatacgagtcattttgtgaatgctcagagttcaagactgcaattttagagtcagggttgggtggataaagaagaaattgtcttactatcacggaaattggaagtgttcacggtcatggcagcttgaactacgctgctaatgggcaaaagagtttactcgcaggctctgacggctaacgccactgaattagagtcaacaacatctcctctaaccacatgggcattagccccagcatctttgagccgtacaacgagcttccttccagctttgtcgatgccggaacggcccataaagacggagttgcgcgctcctcgagacatcatccatcgtgatagactatgttcaatcccacctaagcatcccacaagaaggtaaactttgtctgcgtggaataggggatgatatttggctagggagatctattcaaagggaagtcgatgaaccaatacatgccactctatgagtctcattggtttcatgggaaatacatatgtcgttcgactaaccccgactctatgtaggccaaggacagcatgcttggataccacgtaagggcaccttcgtagtgtaggatactgaggatcccacgtgcacaatggtgccccctgtcacggcacgctcctaattgacaggaccagtgggcgtgggcgtctggaacttcgtggatttgcccacagacttggtgacgaggaagggtcccgtcacattgacatccataatctgcttgaacagtctgggtcgacctcacttatgcattcaaccccatggattccaatctaacaaagattaaagtcggtcaattgtgaataagctaaggcgtcgtaatggggggtgggtaggaagccagcgttaagggggggtcagggtgattcagaaagccctactcctgtcgagataagacagtagtcaatgcggccgaatagatccactacttggcgagtgcctgcattaacggaatcttcttccgtaacatcaacatagagagagagatttacgatttgtggcagcggccttttcctctttcttagcttcctttgctgcgttcagattgacactctctgggccctactgataattgctcaacatacagcttcgcctttttttctaatatccgtgagtgtctctctctgcttccacttgctggagagcgaacccgatgattcgttcgatcaatcagatatgcaaatttatacccatcctggcacatattcgttatgtgcttggtatgaggcagccgcttaagcctgttgtttcaagcaagtgggcgcttggcccagcctgtatcggtgatttagaaatgcaccaggcaactattgatccgcatcatcgtctagctgaggaacaagatagaatcggccggctgataatgccactttggccccatgtctacatgaattaacatataacatcgatgaaatatcgccaccataatgagatctaacagcaatggaacttggtagggttgtgtaggaacaccaagtacatcaagttccgttggtcgaaatgggacttttggctggcctgttcttgttgttttgtaaacgagacaacaatgcaaccatttgaataccatggggagattgggaggtggttttcttacatagaatggagtgattgacagcgaataccctgattaagccctgatattcttaaggacatggaggggcaaatatgcactgcgccacgccatcactctatgtgacgggctgccctgtcgccctatctacgccgctcagcttactcttctcgggctttcacaaacatcatggccatcatggaggtttccacaaaaacagaccatgctacgtcatgagcaagcgtgaatgttttgtctcgcatgcgcatcccttccctgctggctctccctccgcatctccacctccccctccttcttcaaagccggaaattttactctgcctaaccctgggagatccaaattccatacgcgcccacctgactacgtccggctcaaacgatacagacagcgcaaggaccacacaacagagcccagtggctgattcccactactccgaattagaatggcagccctgagcaaagatgaagcgtatgccaaggtcaagaagggacttgaagcaactccctttgagccttccaagctgaccgagctagctggagggtctgttaacttcacttacgaagcaacacttgcgaaaccacttgatgatggggctaagacggtcttcatcaaacatgcggagccctacatgaaagttcggcctgagactgccttgcctcctgatcgtggggtaggtctcacacttgggaaattgtctattgtacccctggtactaactcgaatggacacaataatagaatcttgagatccagtgcttgaagcatatgtccggcagacgcattactggggattcaaatcagacagactctcattgcattaccattcgtacccccaagtactacagctttatcgaggatagctccacccaaatcctcgagtatatgcccgagggcacgacactcaaagactttatacccaagtactttggccacgctactacgcccaaggaatccgatgctcgtgagattggaaagaccgtgggctcttggctcaagtggtttcaccaacttactgccaatgatgcagaaatgcatgccattgctgaaaagaacgagctaggccggttctttaggcacatggtcacttttacttggctcaaggatcgcgtcgagcaatacccttctgtgctgagtgatgccaaagaaatctttcaacaagtggaacaggccgtcgctactgaattgagtgacaccagtaagcttcaagcaatccacggtgatttctggactggaaagtaagccctctatcttaatccttttcttattctttttttccatgtctagctaagaatcattacgtgtaactagactgtttactgacaatttgctctctctagtatgatgattcccgacgcagcaatacccaaagatgggaacaatgtgacactatttgtcgtcgactgggaaatggtacatctgaatgtgcctcatgtggactttggccttatggttgccgaattctattacttttggctttttaagtccatgcccgcaggacggtggatgatggagagcatggtggaggcatacggtcccctgaccgaagaatttgccttccgaacggccatccaggttggagcgcatctggtttgtgtcatcactgatttgaacagagtgcctacggaccagttggaaaaagtagccgccactggcaaggagattcttgtgcatgcctggaagaaggatcgggcatggtttgagaatagcgactttgctctgtcttttccgccagacagagtgagtataagtagttcaaacagagtctatttaaggtaaatctgaacggtgatttggtttgaaatgattgagatcgcaagaaggacacggagagtaggatatctttagtattcaatgacagcctctacagtcccaaactgaagtcgtgtctctcctatccctatcaactcaaagaagcctagttgagtcttttgaactagaaaaggatactttcaactacgctgtttgcctcaaggttgttctgatgaaaaactagacagaacgcatcgatatgttagggatggatcacccgcccgccgcgaataaataccatttgagctcagtcacattcatgcttaaacggtaagcttgaaaagaaagaaagaaagaaagaaagaaaatgagcagaatcagtataaacaagctgctttatgcctctatgcccaaagttatatctaaacatttcgataccgagtcggtgtcctacccaacgtaccaaaaagtacaggaaacaagaatgaaatgaaagattttccatccgtgttccaagtaagaagtaacacgagtgctacggagaagaatcaagcatccgtttctcttctctccgcccttctacgcctaagcgcggatccatagacaccaccagccagacccgcgacggtggctgccaacactgcggcgccatggtaagccggcttgaactggcccctctccagggccttgaggttggtaaagtaccgagctgtgccgtagagaatagatccagagcccatgcccacgagagcgcctaccagaacctgcgagtcctccttctcctgctccttctcacgccgggcctgcggggatcgaggtttctcgtgctgcagcagctcgccgaggtcaagctgcgagaaacgctcaatggcgattcccagggccacgaatcccaagccggtacggatccatgcgaggaatgtgcgctccgaggccagatggtcccgggctaccgagccagtgtttttgtagaggggtgtggcgagcttgaaccaggaggacattgtggatgaattaggtattaggtatgcataaattagagaagttaagccgtaatggcagaaatccctttcgcgcggtgcgaccttggtaagttagcacgggagaagccaaagaagaaaatgggatatcggcttggctgtatgaagtttcagatcagatccaagacgcgcgatgacgcgagcgaatttccaaccttggaagccgggcaaaccgagaccgaggccgaggccccacttgtttgtcggttgtgactaccctaaagccgccctcgatcttcgggatgtcaataacgcgagtagactgactttatatcattgattctacaattcttgaaaggtaagaaatatctaaggtacaccgagttcgttttttgcgatcaaatggacctataagttagcataatgagattaaacccgagaaacggagatactttgaagataaaaccattgaactgaaggctaagctcaaagtttcaactgttaaggaatccttacctagaaattcacagaaaaatctattcttaggactgaaataaaattatgagggagcgatccctctttaagctcttggcatgctttttcgtcttctattttattcaataaattttatcgctataaaaagctgcataatactacacttccgaaggattaacccataaatgtcgctatagtgcaatgaagtcacgagggttcactaactacagctcctgagaagctggtgtgtctgcatcccaaagatgagattgcatgccaaattagatcgattcgacacagagcaggtgctgttcaacaacctgcatatattagaactgtacaagttgaaagccaattctatggttgagtttcgtctcctcctctgatcctctccgagactctaggttaatataaccctgcctgtatccccaatcttgacagcggacgttgtgacccatacatataatagagcccttgatgtctacttaaaactgccctttttattcttcttcttcttcgtcagtattagcgggccgctggtagttctggaaagacactaaaagtccaaaatcataagatatcttaatcgcgcctgctgtaacgaaggcgacccagaaagcattgttctctgccaacactccggtaactagcggccccaaaccttgagcaacagtcttcaaaacgttgatgaatcctatgacagcagtacgctctccaggaagaaggatactagcaatgaatgccgagcgtggtgcagtgtccatggactggctgcaagatctaagaatcagcaaggtgatggcccagtacgcctcattgggtagcgggatgagggctaaaaagactgaagatggcaggtgagtgaaaaccattgtctagataacaagagaagtgtcagttgcatgaaaagaccaactttctcgatgagacttatttgtgtagtggagcttactttcacattaccaatgcgcttcgctaaagaagaagcgaaaagcgtggagatagcattgaaaatactagccgagaaaaagatagaaccaagctgtccgtcgggtatatcgaaccgagtgcggaagtagtaggagacccatgatcttcgcgaagattagcgattggaacctcattgcgctagcgaaacaccacgcctgaacttgaaaataggcctacttacattggtaccaggccacttccaaagctgtccagagcaataagtgcgcagagtaatggcaggaagctgagactctctctgcttactttgggtctcaaagaacgtcgtagcttggacttacttgtctgaacttccgaaggttcagcaagaagtggtgattcctcgtcaataacgccgctaaccaattgcgggcgagaaatctgtttcgccttttctgctggtgcctcgacagcctgcgtcatacagagggcaaaaactaccttaacaagaccgaggatggcataggtgtagaataccgcccggtaggcatcaagagtcgaccacgaaagagcttgcagtaaatggttgagtacccagccacaggacacgattcctgtagccgtgcctgagtagcccagaacgcaatgccaggcaaagaggtcactatgatccgagggttcgaccaaatgagctagagcactttcctcgactgctcgaaaaggcccaatttcgttaccactttcaaataggcgggttaggacgaggatgtaagaggaaaagatgaattactcacttggcgctgagaacaccaacgatagcggcaaggaggagcagccaaaagttgtgaaacgttgcgaacaccacaccgctcagaaccatgaggagggctcctaggaccagtatcgcccgccgacccatgacatcagcgaccagtgaaagcaccaagctgataccggcgtcacctatcagcgtcaacgtcatgaacagaccgatgcgactttgcgagatgcccagctcatggaggagaggcacgaggaccagggctgttgctccataagcgtaaagtcttacgaaacgctggatacagaggagtttcacgtcaaacggagcacgatacagagctgccaagcccagctcgtctagtacccgatgaaggacattgagggcgcggtgccgttgaggctggtcttctggccctgatgacatgttcaaagatacaatgctagtctcggaggacttggtagaagcatgtcaaggataatgttgctgtgaaatttccgcccctatctaccaatggcggatgatgcttacgttaccttcatcacgcaattgtggggttatatgagtgagtcaaatcaatcttgagttgtggagcattttgctgtttctgggttcgatcctttcgttatggccatctaggtatcgatagacaacatcgaatagatatctggtccaagctcttagtattattattcctagacaactcaaaggtttgatttttcaggagcgcatagcttcgaagccttctactgataagtagagactggtataagttaagccctcgatgcaagattcctggcaagcgctatatacctacttgtatatactatacacctgatgcactgcttaagatactgatagtattatcactcccgaggaagatagcgcgggtgctttcgattcatccttgggatattgacggcaagaagtccctgtttgcaaacggcgtcggctgcttggtagcagctgagctgcggaaatggatcggaaatgaatttgcggcatattttgcaatttttccattctttttttttttttttttttggcgataatgagtgagtgggtgaatcattttgtccattggtgagctgagctcgtagcaggaatcagccagactacaacaggcaaaaagatgaaatgaagcagattcgattacttgacatccattatttagtcgtctaggagctcatgactccacatgttttcataaaggtattcttaattaatgcatctatctatacgcgcgcgtaagcgtttggaggggccgagatagtggggggcgaacataaatctgactacgtagtattgactgcaaggataaatctgactgtggacagcaaggatggatgaaaagaaggcacagccgcttgagtctgattcgatccgttaaaatcagtctgcctagccaaacgcctcgcaagattgggggcgtagtaggcgtatgtagagaattcttaaataaatgctgaatcataaccttacaaaagtacaaatctaaactttcaattaactagtcacttctcaatttcgcgatgaatatctctgcggaaccacgtcggcgatatcaggctctgcctgatggctatattcggcttttgtcgattgagccgtcagtggatcgcgatacccgggtcgagtgccatctctccccagcgaaaatcggcgaccgaccatacgaggctttatcctatgtctggggtcaggaagatgcaaccctcggcattcttgtggacaatgaagaaatgctagtacgacccaatcttcatggcgccctcaaggagctccgcttgacacatgaaccgcggacactctgggtcgactccatctgcatcgaccagtcgaatattgccgataaaactcaacagatcaaacagatggcaaccatttactcgtctgccgcacaagttgttgtctggctaggcgaacaggatgacgacacggatgcagcgctggacttcatccaaggcctatcaaatctggacgctgccacagcccaggtgattgtggacaacgaggatatgccatgggagcttcgcaagcgggtcttcaatgcgcttggtatgaaacacggtatcgacaactatgacgaagttgtcgggggcctcgttaggcttatggagaatacatggtggacgagaatctggactgtccaggagatcgtgctggctgagtcggcaactctgagatgcggcgcgaagtctgcctcgtggggcaatcttagcaagttggctgcgtttgccctcgaggttgctcatcacaacactctggatttgggacggccaatggacgaggcaatatttgatgaagtcactgctcgcgtgtctacgttatacattaccgttggctctctcaatagtctctcatacagaatcgcccaaagcttagacatacctttggagcagatgatctggcctcagctgctcacaagacgagcaacaaatcccttggacgtgatatacgcactcctaggcatggtgacggagaagtctgtcatcgagatcgactatgggatgagcaagaagcaggtgtacacgagcactatgaaagccatgctcgagcggggtcatcgccttcttccactcaatcttctgcaagactgctatatgaagcgcgatgatagtctcccgtcttgggtacccgacttcgaaatcctccattcttatgcgactattaacctagccacaagtggtgtcggaacaaccttggctatggcctctttgtacaacgcgtcgctcggagatgctacggatcaatacgtaccccagttccttggcgacgacaatgatgtcttgcaggtagaaggtgtgtcagtagatcaggtggcaagggtagggaacgtctgccctcgcttccccgacggatgggaaaagcggtcacttcagcttcaaactgttatcaaacaatggcgtgaactcgtaccagagacaacagacgcgtacattggcggaggctctgtcattgaagcgttttggagaactgtgacatttgacctcgagctcacagatcgagactatctagccgggaatccagacaggagggacaagagattgccaagaggcgccccagggatgcctccgacaaccgcagcagaggaagctgagatactggagggaattgtcgatgcccctcctcccaagacagtcctggagaaattgggtgaaaggcgcttgttcacaaccaagtcggggtactttggcctggggccggcttccacacagcctggtgacaatgtctgtattttgcgaaatgctctgtttcctatcgtggtccggccaaccacgaacgatagatacattatcgttggtcatgggtaagctcttgatatttatctgattgtccaaatgaagaatgctaatagtttgattttttagttttgtgcatgggattatgtatggcgaaattatcaattccctgaaggagggacgatcttcacgacaggtgtttgaatttgtataaggggtatattgagcggaggactctaagttcaatagtctcatgataggagatctactggtcatattccgtaaactaatccgagtgaagaatacgcaatggcttattgtctaacttagaataactgcctggctcgacctatatttttgatctatgattacctatggcgggtttgtaaatatgtagtttttagagagacaactcaattacaaatactaataccaaaagagactcggaacttggtagttgacgaaattctcccactcccagtctgacaaaaagtccctggtattaagagtgacagcccagtccaactctttgtcactttgcacccaagcacgagcaccgttgacgctcccgtcacgccgtgacatctgccgatcgccatacccataggcagctacacgcatcatggtggttagctagatactttttgtgcaaagtaggggaagggtttgagattgagatgcttaccgtgtgatccgacaaacttggcaatggagcttgcgcttccagctaaagaaaacgcacccatggtctgcttcttgatgtcgcctcctcccccatagacacctgaaattcgttgattggacaacggatggagcgcgtcatacccaatgactctggtttcctgtgatatacgatcgctcgcgtgggctgctgcgccatccttatatagcgcgatatctagaccgttcaaaagattcttctggagaaactccaggtattccatcccggaaaccttttcaacaatgtagctaagaaccattgttccatagttggaatatgcgtaagatgcatcaggtgcaaagtcgagcggtctcccaataacccaatcaataacgtcttttatcgttgcggttcgactgccttgcagcaagtctaaggcgaccatgcggaactggaaagccgggtcgccagacttgtctcggtcatatccggccctgtgctccagaagatgcctgacggtgatgttggcggtgcgtgcatccgcgtactgatgaaagccaagtagaggatatgctggggttgagtagttgagacgtccagtctgtatcaagttgacaatggcggcattgacaaacatctttgaaacgctgcccaagaggaacttgtcgtccggctcgacttgggcacgactaggctcggcaaaggtaaaggaacgctccgtgacgatggtgccattctttgaaacggcgaactgggcttgacgaaccccattcctctgcatccattgacggaagagagagtcgatattactcttggcgttctcgttgttagcaaacccattaacaggccccttgacggtccatgtgcgctgctcagacaaatccgtctcagcgaaaatggccgtaaagcgcgtgtcgacgccggaacctgccccttgtatttggatggggtgaaggccattcgtcttctgtgttaggatctcggcatccaaagcggatgcggacagagaggcgaacgaagcccaagagccgatattggtgtccgtaaagatgggtgtaatcacatggtcctccgagacgaacaggtgagaggggcgccagaaacgtttcgtcaactcggcttggaacacctctttaaagtcgataccgtaagacggcgtggtgtaatacacggtattgaagacattgccgacattctcgtggccgagcacacaataacggcggttttggggagtgccatacattcggaagctctttacaatcatggtgtgcccgacggttgcgttttggaaggcatacgggtttgtcagatcgcaagtcagtgcccagaatggcgcgcctgagacctgctccatgacaccggcgaaagtagcacgttcagccgggccagtcgcggagacatgggtcgcgacatagcccttggcctgccacgccgtccaccaattttcgaaggattttgcgtcgagaccctgggccatctcgaaggctgggccatctcgtcgaacccaaacggcggcgaactgggcgttgtcgggctcgccatacgcgctgagagagatgacgcgatagccttgctgtttgagttgggtggctctggcagtgtgctcggctccattgacggagtggtatacttcatatgtaggtcgagtgctgtccttgcaaggcacggccacagccaaagaaaagagagaaaggagaagaaggaaagaggccgcataacggctaaataacgaacgcattttgaaggggtgcaccatggtgcgtaacgagcttgtttaagcaaaggtgggctgagatgctcaataaatattcaatgcccacatcatgtccggaagattaagagtatttatcgaagtttactctatttcttatgctcacatcaagttgcacgagagccaagcccgtccatggtctcgtttcttattataaccctaaccggaatggccgtacatctccccagaataacgcgagacagataattggctgcccgatacgggcttcgatctgagcctcgatcccctattgctgctgtgcaacagattattccaagccactttgccagggcagactatctacaagactattggaacaagccggctgacgggctaacacgagcggataccgcgcgggcgaattagacctttggtagcagctgtaaaactccaacgctggggagactaataatgctactgtctcgtagccagtcatcagtttaatgtgaatgagggtgatatgtgaaagaatgatttcatttgtgcttgtagttttccaacataccagtctcttcctttgccatgattttcacatggtgacagacaggccctgcactaccagcggcccgcatgcgaccattgaccataattattagaaccgggtcttgattcaaaaaccaagccaataattccattatcctctgccaaggccccaagtcgacattagtggctgaagaaacatgcagcctctttcggcctagactatgccatctgctggctaggaggatagatcatgattctaaatcaagcatattcggtggcgcagtctatcacataatacagtctatgacggaggtttcaggcacagccttggggcatgattcaagatgttgttgtaataacgtatcctgctgcagcttcgcaccgaaatcaaaactgggatctttatgagtctatctgatagttaagcgcaggctcaaaaatactaattaacacatgatacgtatactgcacggtattgatgttctcttgaaccttttcatacatctacaaaatatgttgacctagctgaggagaaataacgttacattcaatcaatcactctaacgctagaattatcacctcgccctaatagactagtgatgtcaactgcatgccctcgcctgagcttccagtcgattgtatgataaaattgttagcatgatagcctaggtaggtacatagaatatgatacagaaaacaaccaaccttgtaaccataattgaaggctataaagttgctgtctaatattagactatatgtgagcaactgacagcataggacggaggcctgtcaggctcttcgccagatttaaaatcaggagatgaaataaggagatcgctattagaacaactctggaagatgtgaactcttaaaccggtgtgaataatggaattacttctacatgtttagttttgcctctgatagccatacacaaacggcgtcggaattaatgtcacatctgtcctctagcagcctgtgctgcgacttgtctccaatcgattcgcagtacatcgggtcggtattaacaagtttctgaccaacttaagaatcaattgccatagccgcggcctagttaagttggtggaaggagcggaaacaatagtgtagttggccgcattcaacaagacctgcttgtctgcctgctccagcgtggccggccctgggcagccataaaaaatgtgtcatagactttttctaccaaagaaagaaatcaggggtgggctacatcgaatgcggcctctccagggcacttaatgaagcattcgcatatatagcactatttgtggcgatgaacacaacgatggaggtcagcaattcacttagtgcctgtccggatgcgcataaataaaccacaagttgctcaaatatcacaaacttccgattcgacttccatttaacgaattgaatctatcaacatgacgccagtaaagagttctgatgccatatacagtgagaatccagacatgtatcctcctgatgggcctctaattcctcctaataaagcttggaaaccgtcttacactgctgattatcacgatccagatcgtgtccaaccagaaatatctagggacgaatataagaagtttctggcagcatattatcaaggactcaaagaagaggctagaagacgggtcagaggccttcaagaaaatgggttttatcttcacgtccgttattttccagccgaagcctattggtatgaaccaactcctcggaagggcgagcgaagaacaaatcaataagcagatcgagcggtagtacattaattatgaaatgtttgtgtttctcattatacgctttctctgtaagcgacttattgattaaatttaggtatctttggcccagatccatcaccctaagccaactgtgacttggaccagggcaggcttcaggcattgatggtccaccctgattttgccattatatcagacccgaagctgggctgtccagatctcgttttcccgttcgctgtctatgaggccaagggatagagtggtgacgcccgcgacgcacggcaacaagcttgtgctgccggagctgcataccttgacttagttgacgctttggcccgagtaccaagaaacagacgagatcctaggggtaaagaagtcgagtatcaacctgacagtcgcgatgcccgtcaggtatttgccttcacatcctttgaaattactggcatgtccttgttggctacagacgtcctcgatccgaaacagcactccgccattgaaggtatgagcaagaacgtatacgtatgtctcccataactttacggcgaatcttcaaaggctgtggagtgatcgtgccatcaatgagcgaacagcttgggaactctctctcgtggatcagatccatgagtggggagtgacagtatattgaaactgtatcgggcgactcctcaagaactggcatcatccctgcttccaggaatatatcataaatgcttccacattagccagtttgtctccttccgacttgtctacggtctgtcgttctggaatgacggaagttttcgttcatttacccgacctcgaatggttggagtacctcggacctaccaagcgccaaagggctcgagcgttgcaatgcctctattctgaggacgcattcctcgaccattttcgtccccattcagccacgtaaattcatcatgctgttctacagagggacagacacagagagactgttcgaattctttcgaggcgcaacatgagaacggacgacgagcacaaagaggccagggtcaatcgtcccaaactatgggtagaaggaaaagtgcctccccgaaagcccctcgcggggctgttaagctgcagcccgcattgccgcagccggacgtccccgaccccatagctgctttgttagaggataacaagagaccaggagatcctacgttagaacatgctatcaaggctactaaaagacataagacacaatgagtagagcgtggcgtagagaggcggtttttatttgcttctgttgatagaattcgaggttaatgatggctttttacgaggcattcacgatttaaaaccgccacagtcgcattttgtactcacacgcatgccgaggctatgaattaggggtcgggtaagaatgttaccaattaaacgatgtaatcatggccgtctgatagataggtgaattcgcccgagtcaacgaaccagtggattcggaagcggggttggcaagagatgggctctggttaaaattcatcacgaaatgacgtcttttaggggaccatgacgctttttgctataactaactagtcctcgcgaattcggtaaatgactcacgccggccaaggagtggggtgtcaaggtaaatttgatgttgcgcatataactattggcttatacatatgtattcactgaggatttctctcggtttaattagcccttcaggattcgccgttgacttcggaatgtctcaaaatatatatgacgatgcagacttctttcgcgggtatgctgcccttgaccgatcaactggaggactcgacaacgcccctgaatggccaaaattacgctcctatatccccagtcttcaaggagcgcgcgttcttgatctcggctgtggctatggatggttttcccgctgggcaaggagcaatggggccactactgtcaacgcgttcgatctgtcagcaaacatgttggatcgtgccagatccatgacgaatgatgacaggattacctacaaaagggcagacctagacgcttttcgacttccggacgagcaagagcaggcttacgacttggtctttagttctcttgcacttcactatctcgtcaatcttcgagaactcgtcacggaaatctacagagctctaaagcccggcggaacctttgtcttttccattgagcacccaatcttcaccgctccgtctaacgcccagttcatcacagacgaggcctctgggcgtgattattggcccctgaatgactaccaaaaggaagggctgagggtaacggattggctggcggaaggggttcgcaaacaacaccgcactaccgcgacctatatcaacacgttgcttggtgccggctttgagttagaacggtttgatgaatggtatccaacagccgaggagcttgagaaatatccctggcatagagtgctggatagacctatctttttgttgatgagtgtaaggaagcgagcgcgatagctagggttgagatatcacaagtctactcgacggatagatagcagactcaagtctagttccttaatgaaggtgatgtgattaagcactgatttaggcatataagttgatcccctatgaaatacaccgtgattcggcctacacggaggggttcctactttcccatgtgggcatctataaaaagtaaagctgttcggcatatcttggatttcaccacgcgcttcagccaaatcatcataaatgtcgcttccaaggcgctccgagtcggttctccgttatgcagattgtacaccttctattctattttgaaaactcacgagtatctctattatggctatctcttctaatccccttttcccttcattaggctgggagggtcttgacatactagccaaatatcagcacgagactagacctcccactttgccatatgccagtccaattcgagcacagtgggttcctttccaattttgacgatgtcatggatctcctggcgagcagccacacatgcactctcagtagcacgaattaagccatccgggccagagctataaacccatgccgccctctctatataggagctatgcgcctcgatttgcgttgctccacactcctggccaagctcgagggatcgtctgatacattgagatgggtcgagtcttccgctgagagagctaatgtgttcaaccacgtttaaggagggaattgtcccagccattgcctttagctcctgccattccttcagacatgccatctcttcgtgccggacggaccatataagggtaaatttgctgtcatcgttcaaacccctagccttgatccaccacatcgcaagactgtaggcacctgtgataccagtgccgccgacaacacatataatgtggaaggccgcctcgtatcccgtgtcactcggtcggtacgggccttcaatcctggcctgcaagtcagttcggccttcgagcgcggaggtaaacgccgccagcctccatgtccattctttatccaacttcttttggttcttgccctgtgctggctggaagagaaagactgggcccgaggacattgaaccggggatggcagcagtgaagggatgattctgaagcttatcgacagcaggaaagttgagatagtaacacgcgagagcatcgcccggggcactttccttctccgttgatataagagcacggtatttttcgatgtgaacgtcctgcactgggagggagattctataccagccgtttctggcatcctcaactgacaccacctgagtcttgtgaagtccaccagcctctcctccaaataaacgaatcgcccaatcaacggtccagagaaccagaccaggtatcagtaagtatatgtcagtactggcgtgtattccagcacccacaagtatgagaatactgattatcacatggctgaagtaaaagacgttgtagaaccggcgtcggacggagggcagtgccgtcagcacaatgagaagcaagactacaagtgtggcagcccctgtgtaggtggtttgcgtgtaccaagagctccttttctcgctttcttcaagtgtcatggccgggtttcccgtagcaaaggcttgctctttgcgcacgtccccttcactgctaggatcgagggcgtatagctatcatttatcagcttggaaactgtagggtgttgagttggcttgacttaccccgtatgccactccatgagccaaggttgccgccaggaataggtaagcgataagtttatgtgcagagagcagtgtgctttggtgtacaccaaatgattggcccaccaagctgttccgtgagaccgggatcaatagcagcccaagcagaatatcagcgtagtgtccagtaataccagtcactgtgagccggatcttggcggtgtcccactctagaggatctgtccttgctccccagaactctaattgggctggcagccagaaggaagttgtagcaagcgtggtagaaatgactagtagtgagatggtaagaccgccgactgtgatacgctttcccaagactgggagtactggggacaaatgggaacgagataatgaccgcccaaattgagttgaaacctggagtaaaagcagacaactaccagccatgagcagcccataatatgtggctatgtgaagtcgggtctcgaaagggaagtggtcttctgagcaaattgtcgcatagcatggcaaatatgtcaggccgatggccaaactagcggatgcgatgattagaataaaggcagcaacgggacttgctaagtgcgccattatagaaacgagaatgataacgagcagttgcggtgagttgatggtaatgtgttgaggtgatccggacatcggtaacatggagcggatggcatgtactttaaataatagaatatgatagctatatttcgaccaaactctacctatatttaaacgaggctgtgcctcactattcaaacccacatatcatacgaaatattaggatcccgaccttgtaagaagaaagaagctagcagtttcagtctgatttgtgaaggtcaccaccatcttcaggaatcggtgcccgagattgtcgggaagtcagcatgagaagacaagccctggttttcaaccgatctttactcatttagagttttcaaagtggcttagatgcatccatacaaacatgccgctcagcttaagcttaagatgacgtccaatgacggccaagccatgctcggcagatctttgcttgccgcacacccctgttcggagcaacttttagcacgtatctactgaaagatcatccggcgtaagcatttccttctcctggttggaccattccgtgtcatgtggatctaccgaacgcgccttggccagtcagccaagaggaacgcataatggtacgtccaggttgccaggctcttgtggtttgtgggtatatgtcagcgctgctcagcccaagtgccaaagaccctccgtcactgaaattgcccactcggaccatcttcttcttctaccacggaataattctcgccagcacttcccttcagttgccctaagtcgtgcgcccacctaaccgactaggcagcgtgagcactattcaggagagcggcatgagagagctcagatctgcagcctcaggtcctttacccagcgacccgccatcaagggtctgcgatcggtgtgtccggtaaggcgaagcttccttgctttcataattggctctggtaccttattaacgtcaagatccacgcgcaggcgaaaggtcaaatgtacgcgcagcattagctatcagcaatcccttccatctatagaccctgccgctgacctttctctaggcgaccaagagcgaccaacatgctcccgttgctttcagcgtggggagtcttgctcctacacatccacacgacgcaaacctggcccctcgcgcggctcacactacaatacgctgagagcgaagtcgaagcggtcatctagtacgtatagataacggagttcagaagttttcactcggaccctagctggacactcgttaactagcacagcaaaacccagccagggtcgccctaattctctgaatgagtctcctactctggatgccacgttgacgccagcggcacctatatttacacaccagcaagatgattcgccctaccagtccagttcaacttttctggataccccggcggaggcatcaaccagtcatcaaagtgtcatcgagttaggcatcactccacatcaagagcaggatctgtatgtgccttaaaggtctttaagaacgggaagagccgctaatcttctgtcattcgttttcagccttcataaatacttcgagattatccaggatgcgagcccaattttctccaaggaccggttcctccaaggttacaaagagtcttgcagcctcgatctcatctctacaatggttgctataacagctaagctaaccaaaagcgacattttcgttgacagctcccaattagactctcacatcgacatgctgctgcatttagagtcactcgaggtagacatgataggggattgtccgtcgttggatgagttccgtaaggcctgcttattggccgtttacgagttccaccagtttcctggacatcaatcttggctccgaatagatagacttacacgtatggcctatcgcgttggactggatcgtctggagaatatgcgagccctctatagcgactgggaggctgttggagagcaggatatgcaagaatggcgggccgtgtggtggtgcatctatcacctcgactcttactgtaatctggcaacgggtacaccgttcctgatcgaggatgataacatcagcacatccttaatccagtgtcacccaaacaacacgcccccggatttgtatatgcctccacgctcaggatctttgtgggagattcttccccccattacctccaacactcaaaccagtctcagaaacatcaacgtcattacggttgctgccacgcgccaggttgggctcgccgcacgaatgcacctcttgcggggaaaggaagaaacaatcacacgcctcgcacacatcgaacgaaatctgttggcactccgactagccctcccttctggctggctaaatcctcgacgcaatgcattttcggacgagtctcctgccgaccatcatgcgaggttgatcacggtccttcatctcataatggctcaactcctagtctcgatcctcagctgcagttgcagctgcagcgaaaaccaagatgaagaatggcttgtgaactggcaaagggtgcttgagagttgtcaagatattgcgactgcggcctcagcgtggaacagctccttgtgttccacagttgatcctgccatttccttgaccattttcacggcactggtcttcctggatcttcaccaaaaatcttcccttatttctgcagctagcctgaagtctactacccagcacaaggatattttacgcttacagcttgaacatttcgcgagtatatggacgcttcctcgacttctcacttgtatgtaagcccaatcaattctaactactagggctttccctacctaacgcactcgctctagtatcattcaagggcttcagcgagtcagtttctgggccgctctccaacatgcaaataggctcgataatgtcgcgcttcgaagcccccttgcaccctcgatggctccagttcatctcgtcttcccaatcagtgtcaggcgcttgtagatactagatggtacgcggatcacacgcctcgatatgctccagttcttggcgtctcagcctttaatatccttcagtcatcgtcagttgagaggagctgcacgctaggcccgccggataacaggaaaaacaaatcttcaaatgaatccgctttctgaaaaaaaaaaaaaaaaaaaaaaaaaaagaagattgagttctgcgataggccaagtgtgtttagattctagccgctgcggcacttcctgcgcctgattgtctccggccaaatatagaattgtaccccgaccaatgtattatccgtgcatgaggctggactaaagctgattgtacatagccctttctgaccaccataatcgttgtccaccctaaatccttccggaatgactaagacctaaattcacccgctgattattatattctgtgatcggtctttttttcagctccctactgtagggtgttattcaagtcggttaaatacaggatgcttaaacctcccctcttgttttcaacgcttctttgttttatttccttccccctcaccgtgttactatactcttcttttctcacacgtcaagcacgcagagtgtaaacaacatggcgcgattttcgcttgtaccgaccgaagtcatcgaccagatcttgaaattcgtgccgagatctgaccttgcgagcttatgccgcgtaaacaaatcccttcatcaatctgccgagctctttctatattccaccattgaaataatatgggataaaaagcaccagaaaccttcgattgctcctctgctccgcactcttttccatagaccagagctattgagctatgtagatgaagttcatctacgtggagcttatttccctgatcatctagagcgcccattactggataccgctactgctgatatcccgctcgatgaatttgttaatactattaataagactaaagtatcatacgccgatctctgggtcgagcgcctacggtcgggcaacatggatgcatttgcttgtcatctaattgccaatcttgctaagattagctatcttgatatcacccataatttcatcaatggcaatgatattcttagcgaggtccttctatctaaggtttttggccagcagaggagcctactcttaactacttaacttcacttgatattgggtggtttgttgagccctatatggcccaattactcccctgtataccaaacctaaaatcacttcgctggtcgtggatttatcatcagtctccaaacgaagatatggaagagaccattcttgactttgataagattgttgaaatcttatcaaatatcaaagagtcgctagagacttttgttttttctatggcaatcgggggagatgattatgagagaatagttgatgacatggaattcttaggatcttttcgaggtctacgcgaatttaaacagctcaaatctctctctatcccactggtatgcctcgcaggctttggtagcgagcctatccctctggagcaatctactcctgctggtttagaggttattcatctccgatgggaagacctatccggttttggagttgaagttgggtggtataatggtaatctgtttgaccatgttcgtccgatgattcagcctttggtagagaattctccaaacctccaccttcttactgcggtcggaagcttattcttattaagaaatacaatataagagctaactatagattttattactaatcttctagaaattaattttaataaaagaattacttttattattataataaaaatataaataaaaagaaaaaatattaataaaaaaatataataaaaattattaaaaaagaattctatttaaacttataattattatatattcataagtttttctaataaaaaaatttagaaattaaaatatatatatatttataaataaaaagaaactattttatctatataaagaaactattatttatttaattaaaattatttttctacttttaaaaaggtttatttaaaatctctagttctaattaatatactaatcagtctaatagagattatagattacagaataactatccttccatagaataaccctatataatatcgtattatacaatatctaccagtcactctcaggcactggcagatcctagatggcacgcggatcacaaacttcgatacgctccagttctaggcgtttcagcctttaattacatctatagcgaacggtacttgtactccaatacttcatgtcctatcaaatccaatacttgttcgaaaagtcaccatgttcatcttcgggcaaaatacatctctcgatatatgcatccggaacgaattacttcagtaggatggctttgacaacgttgtgtggaggatcgacgcaaaagacgcccggtgcaaatatcatattagctagctaccatctgggcactgaaatccatattacgtgtccttcattacattggtgtcatttgaatcagatcaccaatagagtttcacataagaaacaaaggcccaggattacacgagaggagtgtcaagaggatagaacaatatattgagactttgtgagcaaccatagtgtctgcagtacatgagaacgagtcgctcactctaatctattgttgggttttgaatccccttgcttttctcagaaaggtgcgagttggccaattacaactcggagaagaacttctctacatctgcaagccacagatcgggttcagtcttagcagggaagtgaccgcctctttcgtgccggttgtagaaaacgaggtttgccgctctcttgataacatgttttggctagttttccaggttagtgactagaaccggcatctaatcaacaatcaagttcacttaccgcaaagttaatatccttgatctctgggaaaggaccgtgggcaaacccccaggcagaatatcccgtaggcacctcagtccttgggaagttgcgcatctaaaacatgtcagcatctctcactagtgaatcaatgggaactctgatcatttacggtgtagatggtgcggtacgagcggatattggcaaacggtcccgggaaccaaagcatcaatgcgtccgtgatgatgtcctggaaatcgtccgggtatccatcgttggcggtgcgcgtgagatcccacatccaaccagcaaaacccacagggctatcggccattgtgagtgctgcagcgagaggcttctgtacgtgcaaggtcgagtatgctgaatgagagttggcccacacaatcgagctgtttatccaagcattctcttcaggcgttgtctcattcttggcttgtcggtcgaggtcatcttgtgttacttcaggccagtaaaaatcagtgaagtgaccaatgatattactactgtcattgaccatccacatgccaactatccatcccagatctgtagaaacaaggccatacttgtcgtatccgagttgcagcatgagagcatcgaaagcccctcccatttcccgtggccccatgccagtcttggttggggccgggctgaatccgaatcctggaagatcaacggccaccacgtcatagcccttttgcgtcaaaggctcaataaccttggcccattccaaatgtgaagatggccaaccatgcaccaggagaagagggatggcattgctcgcatcagatcggtgatgaatgaaatgaagcgggatgggctcctgatagtctctattcccagggactgtcacggcgtaatgggtgaagttatcgttgatttccttttgggtagctctccagtcatagtgatccgcccagaagctcgaaagacccgagacaatgccttcagatggcccttcatcggaccagccctcgtcaaatccctttgatggtcgatagctgcgtactttttggatcatttggttgatgagattgtcgtcgaatttaacatcgatgggttggggattaacactcgacggaaattcataggacgggtttttgatatctcgagacatgctcaatgccagtgcacttgaggcaaagagcgcggaagacaggttgagaatcatcgcgatgcttgatgagagtcagacgaaaggagtatctagaatttgttgttgtatgatatgaatcaaaatcctcaaacctgtgttatttgcatctttaaatattttcaacctttttttttcctccttttccctttgtattgaagcatttctatggcccatagtcaaaattacccctttgtcagccagtgtcgttgattgctccgattttgccgacgatggccggaccttaactgtcacggcatttatcagcaatgcatttctaagcactctgaatactgtgatatcgcaatgcgaaattaatgacccgcaatatactcaatcataattgacctttacatgatttgaaatcaatgatgactgtcgaactgtgacagggagagcgaggggaaagttttcaacctacacatgaaggtatacaagttggacacacaatggaactctaatggctttgtggtataagcccaagctcctagggtaatcttattctcatttttgtgttgtatccaacaaagttcagtgtatcctcgaccggccatcttgggtaggccagggcatgcacgccgaagggcgtgctccagttacataatgtggatttttcaagtccttaagttactttcagtgacaaagttgcacattcttaatacatctcgctagcgtagagttcccgattgaagacttgtccgtgtctgaagaccgcgccgatactttgtattcttagtccttttgctcacttatacgacgccaaggctagtctcaccaccgatatgaatcactctcgtcatgcagtttcaaaatctggaaatgtgcctgtcaaacccttagtcctagtaggagcgatcgacctggtctaaactagaactgtcataagatgaaaccgtcaacattccctggagctccttgagtagtaagcacgttgatggcccatctagtcagagctatgcccgaaataacaaactgtaagcaaattttcttcaagggagattaagtaatactgctcggccctactaactctgcgactgtggccaagtgatccgatcctatttaaaataaaatatttcgattagcataagttctcctcatcatattatatttcgtgttgactgggctcgccctgtaaaggaaaaacaaaggcttgttcattatatcgatgtatcttctaagaaaatcacatggtaattgggaaaccatcattatgaaggcctccttatttcgtaggttacaattattatttaaaataatcaagatgctgattacttcagtagtggagtctcgttttcgtgggacactttttcttgagtcttacctcagatgcggggtaataggttgaaagttccttctaatccataataaaacaaaagccaagtgagaaaagtcctcaaactacccgagaaacacagcttcagagtgctaataaccccagaaaattaggccatacgtatagttgatgtctagccacaagagcagcccgctaacgatcagcggcgacaactgtggcaaatgtcgccgagccatcgtggaggcttactctcttgccacggaccaaccgccaggctatggggactgggtcaatgtctttgctagttttgaacagctcgaagccccagcccggaaatgtaacctttgtcgcatcattcgccaggagattgtctacaacctagcgaacctgaaggacctcgacaactgccctcaaccagtggaggcgtgctggcaactatcagataccgagtcctcgctcagtacgcttaaatttcaagtcgggttgccctatggagaggtatgccaggcgaacctagtgacgccccatcaactcgagactctaggacaaatcattcgtaggtgtttacccgtgtggctaggagttttcgttccttacggtaactaccttgggtgactttgatgtcgtcgatgctgatgctgttcttctcataagcaagtttcaaggaagattcacaattcaattctattaccagtacaattcactggtggctacagaattgcaacaagaaccatgtttcctgtcaacgttctatctctctggacggcgcgagaggccctttcttgcctacgcatgtaatcgacacaaatccaacgtggggacagcatggatttgctgaaaacaagccacgggggccatgcattcgactagtgaagggagaaggccgtcgagaccaatatgtgacgttgagctattgctggggcatatccggcaagaattacaaaaccacaagctccaatctagcccagcacctcctggagattccctgggataaactcccgcaaacaatacaggacgccatcacagtcacccgcaaacttggtattcggtacctttggatcgacgctctgtgcattatccaggcaaggcacaacgacgacagcacatcagattggccagtcgaagcgaccaagatgggccagtactacgagaatgctacctgcacgctggcagctagcagctcacacgactgtgctgatggaatgcttcttgaccgccccgcgcttcagtttggtcctgcagaagatgtcatcattgacttcgacgatgtataccttggcaagacaacgcggatgcatctcgtagggctgcgtggcccacccatcgaagccgccatggaggagtcccatctgctctctagggggtggtgcgtccaggaacgcgccctgtctcctcgaatattgtacttcgcccgggatgcactgttctgggagtgcaatgagctccgcgctggtgagcatagtcccagtaagaacctgaaattcattccaaggcccaagacgcacggcatgctgtatagccagtcatggcgcaatgtcatcggcgaatgggacctactcggcgcggggctcaggaagcttgtccgagataacgaaaattctagtaaaggactgtcagtctcggatgttgagctgatactaggtccctcgtggatgggtttgattgagagatacagttcttgcaagttcacgaactactcggacagactggtggctctctcgtccctcacggagaagctacgcaggatgacaggggccatcaatatagctgggcactggcgggagatgcttggccgtagcctttcctggacggccatttctcctaccagtacgagagaaatgtgtggtgatcgtagttctccgtcatgggcgtgggcatcaactgacttgggtgtaacatttgagggcctcgacggggtatggcatgaaagcatggtggtggaagatatctgggaagagcctacaaacgccacaaacaggcgctctagaaacatactgagaatgagtggcacattctgtgaaatgtctctggctcaatggggcctaagagagcctcgcaaaggcaacgcaacgtacaggacttcatcctatgtcgagtccgtggcatgggatcacatgccgcccaccttcgatgagacgagactcctggcatgtatgtttattggctgtgtgcgcgagagtgattacgtgtcagatactgttgggcttgtcatcgagcgaacgggcaaattcaatggcggccaagttgaggagtttgaacgcgttggtttgctgaggtttgagaatctttcaagtgaaaggttgctaggaaaattgtggataacaatagatattgcttgactaacagaatagactaacagaagaattaacggggtgtgatggtagaaatgcgttaaatcttgggaggtaaaataaatttgaccctcaacagaaaaacaatcccggaggagcccatcgggaaattttagttcttctttgtcgggattttggcgagtagcagcggcatattttacctgcgcctcctcaagatgaatttcggaggagcctccgactttgactaaaagatgcttgtcactgaacctaacaacgccagctccaagccttggattctgctcaaagattgaggctggcgttggcaactctgccgactggtctcggaagaatgaggtatcgcgaaaatccatcgccggctgagaaatatcagggagagaagaaataccaatctttagtgaaatctgtatcttgtcggtctccgagccttgacactccggacttttagtcgtgtacaggcgaacatactgccaggctatgtgatgaagttgatcacatgacaggatgggggattgtcaataagccactcccctactctccaccccgtcattttcaggccggttgcctggggacggtgagattacgagcccctgaaagaggtggggaagacatgaataacgatcagagcaaggcatgggacgaacttcaatctgcgatgcgctgaaaatggcggtggtagtgacgactccctccttcttgcacgcttcctcgcccagtcacattgcattaaggagagagaaaccgttgattgcctctactaaggtagcacccattcttttttgagcgggcgaagccgacgtacccggctattttgaattaatggcgcgcaactcgcacaagggctccaagccgcccgtcttaccctggtgcctaccacgaaatgctctcagcctatcaggccctctcctagatttgacgtgcatttccgtgattggttctggtccacaaatatgggcatgcaacatacgcacagcttcacccgaagtgtcactgtgtcagagttgggccaacacccatctcaccccatgccagctgaaaccaaggacgcccatgaaaaatactggtttcttaagcagccccttacaaaagcatgaatattgttacttgctatcctccttgtcaacatttttccaaaatgagcaaccgcagcatgtatcttgccaaataccgcaacactaccacccagagagctcactttgccatcttcattcctaatgcagagtatgatcgtgccggactaagccaggactatcgatcatctccgtgtaagggaactaaaattcacgttgttggtgagccaatgttggctggcttccagcttgagatcaagcacaattacgaatgcgacacctctcaggacctgaatgaactggtccatattggccacgtgaatccagaccatgtccacattccatcttcttccaagttccgtgagggagacaatcctcacgggagacttgagagcgaggcgctcaaggtcccaccaccccctaatggacaaaacattcgagcaccaatcgacggggtaagtgttccctagtctcaaatcagcacagcaccatcactaaccattatccaaggtcactactagaaggtgtcaggaatggaccatggagtatctgtctcatctcgtggcgaaggggctggtacactccagcactctttccattgtgcagggagagcgagacgcaccaaatttcggaattttcggtcaatgatccggtaatcgagtagcccacggggccatcgttgttccaaatttgcctttagaatgaagcttggagatagtcagcaataaatcgcaaagactgaccttgccacgcgctgtattgatgaattatcccattattcttttgtttcttgtttagagaatgtggggatggaaatatccacttaatagaactttcttcactaggataaagcacactggcatagtactatgtgttgaatctttcatcatctaagctgtcttgagtaggatattgcaggtgaaatagtgcagggtaggtaaatctgcctaatagcaccacgggctataattgagaggactacggattcgcttcaataggtgtctaatctcatgaaaccctaatactacacgtaattttaaatcaggttgggagttgtcttaacttaattttggatgatgcacatcaccaaggagcgaacgccgtggattattataaatatacaagaatggacccctggtacgagatttacgagaacaatcgtatctttcgtgtcgatgatttcttggccaattatctctgaagacgagacccactctcgcgaaactcgtattgattctccttatacgagcacaaacccgactgaatatcacgatctgcggaacatcacaactagccatggagcaccgttacagcgcgggaatgatacctccgtgtggcccgtgtcatacctcagaaatgttgagtaattagatcactctcattcgctccttcagcagcctcgtgtttactaaagaggaaccgtttcccgaatcgtgaacttctgttgatgatcccttatattgtgtcatggcacataacttgccaagcgagttggaggctgtcattggttcctcaattgtaaccagaaggcttcaccgggcaccctaggaggtacgttcatgcttccaaattgccatttgccatgcaggatgcgaataagggcaattgatctgctcaattgctttctgagtggctttcgataggtcgccgacgggcctttggggagcaaagcataatcagagcagatgaaaccttccaatttctaaattaggtgggtgacgaatagccgagttacttaccaaattcaatagagcgctggcgacgaacatctacataaatggctctttcccaacacgttcggaatacaacaagactattccctttgattattatcatttcaagtctattttcgatattggttctttcaaacaaactcatagtcaccatgaagctttcaacatgcttggctactcttacaacagcttggggcacggctgctcgacaccctcatttagaggagggaaagtggaaagccccgggagcagacgattgtgcgtaaacagacggaccaaatttagattctaactaatggaatgtagttcgcgggttagaaattacttttccaccaacatcaccagacagtctcccatctggaagctaatgtcaagcagaccctgtcctatgatgaacaccctggccaaccatggatatattccccgcgatggaagaaacataacgagacccaatattattgcaggcttagcaacggggcttaacttcaaggagcctcttgcaagcctaatgttcgacatggctatcgttgctaaccctgagcccaacgcaacatactttacgctgtagggttatacggataaaatctttaccaatgtctctctaatctgaggtttcctagtgaccatctcaaccaacacaacgtccttgagcatgatgcgagcctcaggtcagtcattacgaaaagtgttcccttgccgtcacggaacttgctgatgtttgctagccgcactgattcctattttgggagcaaccatatttttaattggactatctacgaaaagtcaaaggcctactggactgaacctatcattactgctcagatgctggccaacagcaaactcgcccgccaagttgaatctcgagcgtttaacccgacgtacagattcactgccgatacggaaaactttagtctgggagagattgctgcacccattattgcatttggggatatggcccttggagaagtcaatcgtaccctcgtagattattttttcggtatgttcttgtctacactttcgtacatcaacgattcactaatgcctcactagtcaatgaacgactacccgccgaattaggatggcacaagaaggaagtggccattggcgttgaggatatcctaaaagtatctaacatgatcaaggctgcgactagtcttatcactggccctgatcaatctaactctgggaacaaacgggacttgcacgccggtatacactcctaaggaagactttatgctatctcggggccatcgcttctctttaattaagaggtcgaataaatctgccgtcagtcaccagtggtggtaggaattcatttgattcaaggagaactgcggaaaatgtttttctttttccttccagaacaaagtgccaacatggtacgttaccaaaatgcgagataggtcataaagagagagacgtcttgttagttagcctaagttatgttatcaatgcgcgttccctcttctaggtaatcttgctctcgggctgttgttcaataagatcaccacctttcttaacaccgaactaacctcgttcaagcattgatgatatgaaattctcaagtatatttcaattataggtgcactgatataccatgatgctgcctgaacatttatttttggttgatcgggcgtattcgtcagctctagtgtaaatatatgatactaccaacagacgaaaaggctctgcaggaaaggtaggtgtccttgtgtgagattaataaattcttttgggcacggataattgaggaagtactgtctcatgtcaagtctattgaatgcctgcccccgaatatatagatgagacgtgtagctgtctatggtcaatatacaagcccttaagttactgctgaactaccttcttcacaatttcagcaacttgctcctcggtcagacccttgatgccaagcaactcattatcggtcttctcaaagttgccgccgtatgccgggtcggtaatagcgcggaaaagataggggataaacgtttgggcgtcgaaaagaccttgagcaaggcgatcatcagcctgggcagtaagatcgtcgacctttaattgaatgggctcccaggttttattgggagtggcttcacgcgcaatctttagaagctgattttgcgtaattttagcgtcctcgacgtagacggcgcgattttgggtctcctcgggatgtgagaggatgccgacgacggcatcgccgattgtggcaagcgtagtagcggagaaaacgcggtcaccaccatctagaatcttcggcttgccatcctcgtgcgagaggaggaaaccatggtcaagaccccagtcaaggaaggcagagttgtagaccagagagaatgtgatagagtcagccttggccttctcgataagatactcctggatttcaatcttcttcgcaaaaacaggcaactttcgagttttaggattatccaggtttgaaccgaaatcggaaggaataaatcgctttacaccagccgcgatggcagcatcaataagcaccttttgcccagggatctggagggtcccaacagcagagataaaggcgtcctgacccttcaaggccgcagtaagatcgtcgacagacgtaagatcaatgtcgacaaccttgatgttattggggaatgtcgaagaagagccgttgcgccggagaatagtgacattgaacttgttagaggcgttgaggcgatcaagaatgatcttgcccaggttgccggaggcaccggtaatggcgacgttcttgatggcaggcattgttgtatatgaaagtaatgaggtgtagattttattttcggtgcgcgttcaaaagtattattagacgagatacgaaggtgagcttgatgatgttgtgtgacccaagaaacctggggggagatggcagcttaaatatccaggtcatgagagccggattcataacctgctgctctttctgtcgacctgaaactcaccttccagctgctgagtgattattgagccgacatcaagaaagtctccggtattggtccgtctcatcattgcaggcaagatggcgagattcataattcagtttgtcatctaagtgggtgatcatgagggagaggtacttatccttggcgttgtttctagtgtgagtgtaagtacctctttgccttgccttttacgtgcatcatcccacccatccctccgaccaacaccgacatccagatcccacccccactccgagtttggattaccacccacataagcagagggaaatgatgatgttgggtgatggagggcacctgcataacaaagacaagtttcctgcaatatcatccaaagagaccgtgccaatttctcgttctccccgattccgcataagggatgatgcacatgataagcataatcattcatgtgcctttaccgaacttatcatgaggaagtaatgccgcaacggggagagccggcaaagccacagaatcaacctccgcttacctcattttgacattctttcctttctcttacttacatcttgcctgcgaggcggaacagagtatagagcgcgggtgaatgagttgatctatcattccgcttttgtttattcctactcctactattcctcccaaatatggatgccgaccgtacgcgacatacctgccactgtggcaagagtttctttcgcaaagagcacctacgaagacaccaggctacgcacagcgagcgtcaacatgtctgctcgatctgccaacgcccctttactcgaaggtaattcaatcatctcatccgttgaaatttttacattctgcatgatcaaagcgtcttacgcaagattccatccagcgacttgttaaaacgccacctggccacgcacactgcttcagagcagggcccattgagaacggtgcaggcttgtgatgcctgctacgaaaacaagacgaaatgtgatggcggagaacgatgttccctctgcatcaaacgtggcatcacatgcatcatttcgcgcggcagaccctcaaatcagaaggcaggacctatagcagaggagcacgccattacttcagaggatgtaggcaatatttatgaggtgaacaatgatcaagagtgtcaagatatatccgcgaaacagaggtctttccttggcgaagtaacgtctcacatcagcagcgataacgtagcacgggctggaatgagccaaattctcgatcttttacgagcagcttctacagtcaaagactgccccacgctatctgtctctgaccctgtcaagcagtgggtttcattgtgtgctgagacctactttggaccatttcacgatcgatggcctcttatccacgctcctctatttgatgaaacagaagacagcctattcgtcgtttctgccgttgtcatgatcggatctatcctgcgtgataaagattcgagcgttcgcgatttagccctagaggttcatagtcatttgcatggctactgcctagaatctcttgtagccaccctgaaagaactcatcaccctctttaatggctcggtaatctaacactctatagacttcaccgcaagatgaggatctggaatgctccgtttggccttatgagacttatcagctcgcgctcctcaacgtcatcgcagcattagaatttggggtagggtttcttggccacataccccttttcacaaaccttacctgtatactaatatggtcaatctagaagcccagcgttattcggaatgcaaacagacttctaagcttcatcattatatctatgcgagagaagggcatatttagcgccgaatctgtggaacatcaccaatctaagcatttccctgggacttttggcccttggatatacatgggacgtgaccgatggagatggttagtgaacaccacggcccgtaaccagaaaggcgaacaagatgcacatagctgactcaacatctggtgtgcaggcaagcctcggtagttcttcaactagatgcgtacatgtcactatttacctctcaccctccatttctgcggctcaaggagcttgatcttggcttgctcgccacgtacaccctccgtaactcgcacggactggatgtgtttttccaacgcgtgccttatgagccaaaggacaggcaacagacaaaaatctcagccgtggtgcaaagcccacggggactacccgcctcaggacctttagtagaagacatccaaataggcttttcagggattgtaacaaggctgtgggtgtggaggcaaaacgtgcaactctcatcccccccctcacctaccgaggttgaagagagacttcagattgagcttgagctcaacgagtgggaaagtaagatatgtcaactatttgagttattgcaaaccccagagaccaatccacagggagtttcgtttcttcttcacgcctatactggtgaagaggatcaagggaaaagcggctgggagggaccagttgtggccagaatatctgatcttttgttcgacatctccatgttttattattgcctcggcctgcacctctttactgctgaagcttcagtcatacactatgtcagtgccacgccaacggaggatgatgaaaggcggactctgctcttagagtggacgtcttcaagttcggcgagacaggctatatctttcgccgtgcgagcgctccaaacatgcgaaaggacctattcacagaacccccagactaacttgttactcaacccgataacgaagctttgtctaactactgcatgcgtcatttttcacgcttggatcactagtcctcatcgcaattgcacatgccatctaggtcatggcgtgaccatgccaaatgtcgacctaaatgataaagaggctcgccaacaatggattttaatgggaggtccaatatcggtggaaggtacctcgttatgtagttgtgcgtctaacgtatggatggctcgatttacttcggttttggcctgtgatccgcgcatatgggaattcggtattgaagcgttgcgtaatataggttcataaagtatgacagcctgctaagacaatatctcgttgctatgctagctaaactaactgtaggctactaaaactgtccttatttaacttgaaacttgtatcgggaccataaatgaagattcgcaaaatccctttactccagggtttgatcatcatatcatagaggccatcaacaagagccacagtcacgaaccgttatctcagcagatccggagctgtgatagccctcaacagctacaatctggtaatcgtgactgcccatcgccaatccagctttgctccaagcgtcaaaatggcacccagtttgaacggtgccgccagtgcgcttgctcttccggaccgaccagtactgcggaaaggtcttggttccctcgatgctcggagcattatatcgcatacttctcgccaaagtatactcagcgccatcgcaagtcactgttccaaggactgtggcccccgaagatggatcataagtaccaaagttttcaacaatgtaatactcaacgagtgggttgcgcatccagccataaattgcgaggtagctattcccattcggactgtaggttcccgagtacccaatacctctatagaaacattagagccttctcgcaaagaatagttatcgatgacatacctcgcagacctgccgggattccaccccttaccgcctacagagttgccgtttccagaccaggaaactctatactttcctgcagcgagattctcgtaagatgacgagcctccgccatcagtccaccaggaataataaaatccatctactgcgcgtcaattccttttttctcttgctctgcgttttttagaacataccatgagttccggaactgtttggggtgtttgcacgcttgtcaatgccattggcttccgtggcctccgtagtgggtgctgcatgagcacacacggcggcaactgcggccacagcaagacaagtcagggacttcattctttcttcagctagtgttcgaggggtaagagaattttataataatgctaactttcttagagaaagcgacgctatttccatacttagaaaagatcagactaagatatgggatggggagtttatttaagcataactatggcggctgattacaggaatacatgttcggctattcaggcacccatggtctgcataatgcttttaaacaagggatctggttaaatggctcactgctcgtattcgcagcattgcttccgttcccaaagtagtataagtagaaacgatgttgcaataggatgtcgaacattctgtccaaatatttgtagctatgccgctgctacccgtttggaactacattagtttaagactaatcctaattatttaacagcccaatatttcagtgccgaggcggctgtagggaagcagcattataggctgtgtgatcctagaatagatcctgatgtcacctaatcttccattcctccacccgacacattagttcaaggataacctctgtcaagaagtctattgccggaagatatctcattttctacaatgtcggcgtgttagaatatttgggcctatttgttaagtttcaagagggtaacggaaatgcagctcaaatggttctatctctaccctcaaaagagagatggacaaatcctcctaagctcttcaatgggaatggcacgagattctatgctcaagatacaggaggtcataccaaacactattcagcctaattggcaaagccttttcttgtagcatacagtcaaatggggtcataaatttggaataccctggtctgaatattattcattctcttgttaagtcccgtcttcactttgcacgatagggtcttaatacaacttcgccatgacattggcggctattaccagtaactaatttaggctattatacaatcaggttactttaaccgtcttattgccctactatgtctttccaggatggtggcactatattcacgtgcttgtcataaagtatggcatccatcttctgatgcattggcgcaccatgttcgacaagcgattctcggcctcgctggcagaacgctggacgttggcctctgatgagtcgatacctaccaatttatatgctgacatacgcctaaactatctccacatacacctagcaattacatcaggcgctttttcacgctgttacagagtggaaagggctgcccgcaactcctaattcaaatcaagggcctcagagtataataaacaactaataagaataatgatgttattgaagtatcattctaaatgagtcaacacggctttcaacttaatagcgttggtatagtatccccagttggaaaatcttatctttcatcataatatggctcccagtgatctcatctcagtcaatccaatgtcttttgagatcccgaatgcttcttctctaatagagcagggaaattccaatcataatgacataatatctaccagataaggtaaacaagggtaacagtcagaccgcccgaaattcgtgataggattatgcttctcctagtatatataatattttcaatctacacaaaagaaaagagtcttgtttgtcaatgtttagattatatacaagtttatatggcctatttttcaacaagtattattaaacctatggctaataagttcgagagaattctattaatataatgaccctatgctcactaattgattctttgaaatagttcttgttggcgggccccttctgtatcagccacttcggagaaatctctactgctgttatgcggatgataaggataagggctgcaaatgtgttaataaccatgctggcgcttggctagaaacatgccgacgtgatgaacttacccccattccggaacaaaagtaatggtcgactctttgccgtcacgtagaatctgctcccgaataacggctttccatacattctcgaagctttttacttcagcctcatataccggatctgaaggatcagggcactgcgaggcttgtgttgtgccgatcctagagtggatgtgataaacctagatattcgatctaatcagaggtgttaagagatacagatacataagaaaagaatctcacgtggggatagattctctctagaagctcaacatcctcttcagctacatccaacagcctttcgcatccgacaacccagtgtgaaaagtctgcggtaattcgaagccttttcaggggtaaggttagcctttatcgctcttacgttggtttgaccatgtgttaaacacaccctggaactcttttgagaataaagtccgcggcatatggactaaatagggatcggttcctgtgagtttcatgacagactattccgctaagacccaactcggcgtcaattgtgagagtgccttggaagaactcaacagactgctcgtaagtgaaaacgtcgctaaggactgttagctttggttccgtgggctggcttttttttcccttaccttccagactgagcgttgacttttgagggattgaaggctttggctcgaatcaattgttccttgtatgcgatcaggtgttcctggaccgttaggcgaggtcggggccctctgtaccttggccacgcggagaatatgctaattgtgcaatgtcagacgtatcaaatatcagaaagtatcaacagacgagagccagacttcattccggcgatgtgctggacttacagcacatttatctccaggttattctcatcgcaaatgctcttcagcaattccggattgtcaatagtgtgcagattgacctccactccagctaagagattaacagaggacgtaagtatctgcatctatagacagacgattccacccagagcccatggcaagtacgcaccatagccttgcatcttcagtttcggaaaccattcccggtagttggcatagtctggtgtagggtcgatgccccaattggtacggaatcgtttaacaaccaccatgctgaattatattgtaacaggctcgaggatatttactgtagaagaaagaattggtttaatcttgggtttcaaacacatttaggcctgcagatataggggattgaggggttaagtaacgatccaagaatctcggggaacacagcgcaattaccaaatcaggtaagtacacttcctcgaggagtctgccaaatgatggttttctagtgggcactgattcatatattcttactctagtgatgtactaaaatttggcagagcttcagcattgcgccaattacggacctggcatgtcaatcacaccaccatgaagaagccctcctgtcaaggtagttaagggggaatacaggtaacatcaggctatattttaataaaaattacatagtaaatcagtgtttcataaccagcgtccaacttgactgtgcccttcagtttctctcaatatgccaccattttatccagcccactcaattctcgatcccaagacctatgctggcttatggcatagaagaacttttccacaaaaccctttgcatttttggcaatgttaaaagcaccttgtatgctttcaggctcacaattgcggagtgtgacgacgccataactctcctgggcttcctcattagatgacaaatgaatctggggaagctggattgctttctcaacaagatccacggcttcgccagtagcggcaatgggcttgagatggccaaaggcttctctgatatagtgtagcgcgcgaccactcttggatagggtcagaatagagtttttcccccctgggatcacaagagcgtcaaacatcgtactcctctgaccttcaaggtggtgatcaggaatgactcctttgctctctgaacgatcttctccatctgcaaagatggcagacctgcgaacacccagaaccatggggatggctgatgcgagctttagacctgttgataaggccttgaaagcgacggagtcgtagccgtctgcgataataataccgacccggcgcgaggcgattgtcggtgtttctggaatataacccaactggctcagcccaggtgcctttctcccatgattgggcttcccgggctcctcaggcttcgggcctccaaccatctgagcaacagcttgcgcaagatcaaggtcaatgtcggccagacgttgggtcagtcgctcatatactatagcctcgtcacagtggtctaactcgaacgacagtgctgatctcacgtgggatttctcaacgtcagagagggagttgaagaaaagctgggcttgggatgtatggtccaaaaatttggcactcttggacctttctttgatccctgcaaccttttgaggatagtcgacatagccaccctcttccttgcttgctgggggctgaacctcatagcgattgggccaatagttgaccttgcctctcgaaattttatggcgcatggcgccatcgcgattgaagttcataacaggacacactggcttgttgatgggaagctcttgccagttcactcctagccggctcaattgggtatcgaaatatgaaaaattgcggccttgaaggagagggtcatctgagaatccaatccctggaacgatgtgaccagtgcagaaagccacttgttctgtctgtgtaaaatattcgtcgacattgcggttgagctccaattgtccaatataccgaatgggaatttggtcttcaggccacactttggtcgcatcaagaatatcaaaatcaaattgatgctcttcagattcagggattgtctggatgccaaacttccaacgtggatatgcgccgttttcaatggcttccatcaagtccttacgatgaaagtcggggtcctggccggccagtttcagagcctcatcccagaccaaggaatgaacacctagctcgggtgtaaagtggaacttaacaaagtggcgatctcctttggcgttaatcaaggtgaatgtgttgacaccgaatccctgcatcatgcggtatgaccgagggatggtacgatcagacatggcccacatgaacatatgagtggcctcggaatgcatgtacatgaaatcccagaagttgttgtgtgcactttgagcctggggaacctcattatggggttcgggtttccctgcatggataacatcagggaatttcatggcatcctgaatgaagaagacgggtatattatttccaacaatatcccaattgccctcatctgtgtaaaacttgacagcaaaacctcgtacgtctctcacagtatccgcagacccacgactaccaaggacagttgaaaaccgcacaaagacaggagtctcgcgcgatgtgtcggtcaggataccggcgtgggacacatcctgagccgattcaaagagtctgaaagtgccgaatgctcccgccccgcgtgcatgcactacgcgttccgggattctttcatggtcaaaacgatggatctagagcttattagagaggcaatgcttatgcatcagggtgtatatctcaccttctcgcgggcaaacccatcctccaacagcatcggcccagtctgactatcgttgtttacacggagccagtcatctgtattggattgttttgtgccgaaatcggtcgtgattcttgttttcgtggaaggccgaaccacgtcagcgttaagctggctgcccttggcatcattggttgccatagcgtatgcttgttttatagattcggggatcgccggagccattctctttgcaaacaaaactaatgcgcctagatagcgtaatgggctcagatacttcgagacacagacagaaaaaaaattgaagcgaggggtagctggagaaatggtttctttatcgttatagacgctcagtattttgcaatgatagtgtgtgtcgtcaggatggcatcaacattggcaaggtagtattgtccaataataacccaagtgctagtgacgccatgagtttaagttggccaattatatgcgaataggaagaacacatcggcgatggctgttgagtatgttgagtaacagtgggctaataaccaggaccttgtcgtcatggattgtatgaattagaaatctcgactgcctgataggtggtgtataacatctacgcaccaattcctccttttagatgccgtgctcgtaactacgcaacggttgaaatggtccgagcaattatgccccctaatgtatctgatttgcatgatcggcatataagcgccgacaattaagtaaaagtgaacaccacatctaaactaataaatttaaataattcactgaatgagcgtaaagtacaatttattcccgattacacccgttcgtcaagctgcaccaaacttcggcaatatctgacgcttgataccattatggatagtcttggtataatccgcttccaccagggccggctgcagcattgcaaggccggccctgcttgtcctatgctgctgctgcaatggtcaccaggaagggcatcggcctctccaagatatcgaggctgctgcccggtgttatagacggacctgatctcgcggtctagtaaccctctaacacgccgcagccgacgaggcagaccttgtctccattaagctcttgcaggcgccgttccgtgttatggtacacctcattagcggcgtcaatcatacagccgcatttgttcaccaacctgaagatcctggtcagccatagcttcgcgcataaccaagccgatactatctatgcgtctactttggtgaatcccagatccgatgttgagatcttgatttgttaataatgcgtgtaatataattctctttgagggcccagcttactataacccgtgctgcacagtggtcggacttcacgatattgattgatgaggccagtgcgggaagtaatccagccgttcatacctcccaccgtagagtgatttactgtacaaccacgaattcatcatgacgtctaccaagcacccttgcctagcctctgtctgacgtcaaggatatatcacaatctacaacggaagtactacccacattttctccccttcaagcgttatccgatgaagtgcatcactttcagccgtggctcctaagccacgatacgacatatatatcgagcttattctgtcccggcttctagattttcactataaacattagaatctttatcatccctattctgagcgagatggcgtcggcaccccgtattttccagctcgttggcacctgcaacaactatgactgggggaagaagggtcgcaattctcttgcagcgcgcatgtgcgagaaggcaacacccgctggtttcgaaataaaagatgacgaaccctattcggagatgtggtttggtgactatccggacttccccggccgagttgcagaaacaggcgagccattggccgactatcttggcaaacttaaagaggagcttctcggagccaaaatattgaaagaacttgatgcacagcttccgttcctaccaaaggtatacattattcctagtactcaagtcgtctagtcttttccttacacagcctctagatcctgtccatagcgaaggcgctccctctgcaaattcacccgaacaagcagctgtcggagaggctgcatcaggagcagccggacaagttcaccgaccccaatcacaagccagagatcgcggtcgctctctcgaggtttgaggtctttgctggctggaagcccgtttcccagatctcgccactattcaagactccggctttggctcagtttgtcccttcgggcaccaagggatggactaatgacacactaagacatgtggttcgtaaactcttgaaggccgacgaggagacggtcaggtcagttgagaatgagattgcaaaactttccaaccaagacctccaaaagaccatcggcgaggactacatggtggacttgatacaccggctacagacggactacgggagtaccgatcccggcactctcgtcgcgctcctgtgcatgaattacctagttctcgagccgggggaagccctgtatatcccggcggatggaattcacgcctacctatcaggtgatattgttgagtgcatggctcgctccaacaacgtgcttaacgtgggattctgtccgcccgcagaccgtgacaactctgatcttttcacggagctgctcactttcggcccggatagcagaggcgatatcacacttccgagacagaagagcgaggctggcgtcaaagggcggacctcggtttaccgacccccgattcgcgaattcgacatgctcagaatcgatctaggtgcgaacgaggatgaagaaatccaggcgctggagggtccaggcatcggcattgtgacgcatgggacagggatattgcatggggacgatgaagagatagcggttaaggaagctgacatcctctatgttgcgccgcaggtccagacaaaatggagaaccagctcagatctgcaggtacatatggcggttttcgggctaccgtaagactttaggttactatctgtcgttatacataggcgattgcccctgagagacgtcacccttcagggattgggtgagctatcacgctgtccagtgtgtggattgctgtggcaatggagcaacaaatgggccagataaccaaatccaaaattccttgcgcggtatgactgaattgatgacgcgcgcatttgtctaatctctgggattatacggctcatttttgcatcattgactccatctggtctccgccatcgacggccaagagcgctagtggtggggtgctgctaccacacattaatcaaatagataacaggtatgcttgaagttcataaaattctacagcagtccccattgaattcccccttcaaggctcgttattgcaatcactagaatatattatcgtcaaaccatgtcgggcaaacagtttcaacagggtacgtaggtctttgctaccagttttggagcttcctcgctgaatacattgtaggccaccgcgtcccggtgacgcagcaagacttcccaggcaccgagggcgagatgcctaaccccaatccgcagtttcagaacatccctacagaagaaggccagtatcagaaatatagggccgctgggaagctcaagggtcaaaaggcactcatcaccgggggagattccgggataggacgagcaacggctgtcttgtttgccatggagggagccgattctttcattacctacttgccaggtgagaaagaggatgcacagaaaactaaagagatggttgaagagcacggccagaaatgctatctctacgaagtcgatttatcggaactgaagagctgcaaagccgtagtgaatgaggcagtgtctaggctcggtggcatcgatatactgttcaacaacgctgcttatcaaatgatggtcgagtctatcagcgacctccctgagtgagatgatgatgttacaccaatcaagtatagaaatatatctaactgtcggccagtgaccaatggattcacaccttcaacaccaacatccattcgatcttttacatctccaaatatgcgcttccacacttgaaggctggagcaagcattatcaacaacgctagtatcaacgcgtatatcggccgtccagaccttctggactacacatcggcaaagggcgccatcatctccttcacacgcgggctgagcaatcagttggttggaaaaggtattcgcgtgaatgctgtcgcacctggtccagtttggaccccgctcatccctgcaacgatgagcgagaaggctatcaaggattttacgagcccaatggggcggcccggacagccttccgagatagcgacatgcgtggtctttttggcttcgacagatagttccttcattagcggccagactattcactgtaacggcggcgttgtggtaaatggttgaaatgaaacaataattccgaagctggaagctttttgcagcacacaccacagccttgaatgaattttaacactgatcgactgatatctctttcttgaccctgatgttgtttggtggcaatggctccagcccatattctgctgcgtgaaatccgtcgcttcctgctgaaatctgagtcgcatattttccctgcaattctgccgagtcaacccaagggccatcagctgctcgactggtgttttctgtgatcctaaacgcggacgtgtggcccgttctactgcgaaaggaattatactcgctgcttcttggatatgagctaagcttcttcttgtgcttcaagagcgcaccaagtaatggtaagcagctacagacgatggctaacccaagctgcatgcaggaccagaagaacatcccagcatggtcacctacaataagccggattagtttcacttttatctctgcaatagatccctggaggagaagagaaggatgatgctcacttttcgtaataccaacgatgcgcgcaacactggccacgcagactctattcaggccttgttagcatatctagaattggattcattattgaagggaagcatatgcacttacgaaactccgatcaagaatattccaataactgatatcttctttttcgtagagagattgagtttcccaatagtaaagacgggaatgcataggactagaatatccagcaccaagttggttgactccaaggggagaaaaatatcgggagctggggtacaactgccgggaggggctgccggcttccatgcgttggtcggcgggcgacacctgaaggcggccagaaaagtgaatataatccaccacaggatgcatcctgttgtaatagataagatggcaaccttcatcctcttctcgaccccaaaaaggctccaataaaacgacaagatgctgagcttcactatcgaaatgctgaatgtgaagaggacctgctccacgtacaatatctggaaaggaggttgtcagttactgaagaggctaccatcccagccttgtccaattgtctatattaaaacagacataacctagaaggacatatggtcgtgagtaccttgagaaattcgatgaggttcggaggtgacgtgggcataaaaggatcactgcgcgcaatgtcgaaaacatctacattaagaaattaatacatcccagttacaaacatatgcgcgctattctccatgaattacatggactcatgccgcgaacgtgaggaagactctcttacagtgaagcatcacccctgcataagcgcagaacaggaggaaagaaatgaagcataggccatcagaaaggtatgagaattgtcgggccttaatacgcgcgacgattcgcaacgtaatcactgtggatgtcaaaacgatgaatacgacagccgtaacgaagactcgatgcgttgaggaatgtagctctatcatcgtcacctaaaagtctgttcacatggcgtaacgccagagactcggtggaaaaaaactggaataacttcattatgaaaagaaacgttatgctcttcggacgacagcgggggattgccgagttttagtgccatccctgggagcaatcctaccatcggcaggcggttatccgtagtaacagccaccgatcatgtgagcaggggaggagatcctacctcaattatgtgaccactgcatggccaagacgccactattgggtattcatactggtggttgccggtttttagcctatgacggcgctctgacctaccaggagcaaagatgaataggatccaacccacttccgcctggccctttcattttctcgctgatcctactgtgacatcaacttctcgcagttacggtattaccccacaggtcgacgctgagaacaatgtcattatcgtacgcctcgtacaagagatggccatccttgtgcctcctgccactgatctgttttcatggcagggcatttacacattcacgttaactcgattggtaagcgctttgatggcttgcctgctcgaaaaacatcagccaatgacatttacaatagagaacttgggctgtgcaccgaatcacgtaagaatgtagaagatagcttccaagctagaccttgttgtggtaagtgcctcgggtgtaggacagggatttcatcccgaataccaccttggcgacattccgtcccggccgctatctttcgcgatcgaaatacaccaatacctaagaacatcgcccgctgttcccggaatataaaattacatagaagaggtattattattccaaagagaactcgctattctctcctataactccttcctagttggctacgttgcgaagcgacagcgattcgaccaagcataggagatgcttactcatctactccgtatttgacacggtattgttgaaacagactttctactattaacgtcgtcgcctggctcaaaaatatgtggttacatgccattaccaactattgcaagggctatacgctccctaagatccgatatataaccactttttgttgatggtgagaggtgagtaagatgttctatggctctagattcatcaaagtcttcatctttgaaaacaaaggcgattgtgcgatattttcacgttactaataaagaagaagtgcatcgctgttcttttacgtgcatatgttacagtcgtctcactgcagtggcttgatatttccctagctctagccatagtatgcatgcctaaactttcactagatatttagactatcttcacttctgttttgattaacatgaaagatcttaaacctgaccatagttaatgctctactcctagtactcgcatttagttctagtaaatatcggttcttaaccttgaattacaaaaactctccgcatacgcttcgctagccccgaacatacatttcgtattgttactacatcatttgcccgctctaacttagagactggggcactgcatccattattatgataaccgaccacaaggcgcctctactcgagattgaacaaattaggtcggagaaggttccaggcctagagataaataccagcatgaaaggtctgataaagaggcaagaagcatggtcgattatctaaataagaagagcaaagcatacagatagctagcgtgggaagaaacaattaaataagggtttactgagataagcctggagacggaagagttattagcaaaaccccgaaccacgggtatctccagctgtttctcttatagggcgagaattaacgatcgcttctctctggctgacataaattgcatgaatgcccgggtggccattttcctatctgcgctcctgttgcgaacgatgatcttaggacttccatcagacaaatctcttcgtcatatgtttcccatgacggccaatagcgtgacctgtcctcccacaaataatttctggggccttttatcgctgtggctggctcctgttttcctcaccggtcttcaccaggtcagttgatgggatgattagagggtactgttggttgcagtacgtcagagcaaaaggaatattgatgtcttacactgatcccttgagagattgccggctagaattatccttcaatgatgagatcctttgagtttttactttgtgatttagtctgctgtatgtatggacaacaataacatcgaagctttcatttaggctttaccagattaatatcgctcgccgcctccccatggccggtatacttggatctgggcacaacgtaaaaaatccaaccgtcaatgagtccgcatttttcgggaaaggttgttctagagaagcccaaagacctctattcatgatcactcccatactaaaataaaatccaaccaatatttgtccaccaacctctattcctcttcaccatcatatccaccaacgggagttttctttctcttcacttcgtgtctttattaattgcgaatttatcaccacggggcccgtcagagcataggctatagtttgttctctcgctaatgtctttatctacgtgcctatcacgggatgatctgcgtcgaccagatccattgttgctgtctaatcttagcaactatactctactcgggtctcgtcataatggctgccgtggaaatcccccaggatagtttcatcaatggggtatcattaatatattaaacgtgttgatatccaccaattctatgggtggagaatgagtaccaagtccttcaaggagaatcaaacgctaagctaatacaatgcaaaatgcagactgagctcacaaggcatcttcagattatacacttttcacgtccacctcaggagaacttgtccatttttatctcttgtgtgacagtccaggacgttccgtctagccgagcctccatgacagcgccacctttcaagaagaaacaactgttaagatccgacactggctcgagaagccgctcgccaagttcgggtatcgttggccaagtccaagtaggcgtcgttgcgcaggatatgctggttcctttgtcggcgcctttaaatgcatctggcgtagactcctgccattcgttcttctcgccatctctaaatatttgttgaatagtaccggaatcatcctggtagagaatatatgcgttgatttcttttttggatgcgtcagatgacgatgcagccactgagaaggcagcgatagaagccaagtcgtttgcgacaatgtttggaaaagctggaaacattagcaaagcttgattatagtggcaaaagcttgatgaataatagactcaacttacacgagtcccaccacttcgaactatcgtcttggtcagggtaagttttccgtgccccctgatttgcgggatcctcgagtgttataatcttgccatcttcattctgatacaccaaggcccatcgaccagaatcttggatttctgtgaagtttctcgatgttgggatcagagcaagtctcgatccacgcttggcccgaatcttgagatctttgtttttccatggatagatgataagctgaagaacactgtcgattgattggtaggcaacatatggccagtaggcagccagatcgctcccatcaatggcgttcttaaaagtctcgttgttgacgctatccgggttgaagccattcgagcggacgtagttgataccgttgactacagagctgtcgttgagaaagaacatctcgacttgaacctagaagtgagagagaaaatatgagcatatgtgccattcaggttgctaagattgaaacactaacagttgggtcgctagtaatcataggaagaagcgacacggctatccctgtattgtttttcaccgagtattctggtgtgagcttgcctgggttttcccacgcagctttatcgaccgaacccgaaccagcagcgagggattgtcgaagtgtcccattcgagtcttggtaaaagagaaaccgagtaaagcttccgtcagcctgccatgcgaccgcggcaagatgggatttgggggcaatcgctacttgtgacggggcggtcgtgggcgaactcgatgcggtagatgcagttgaggtcgaggatcgttggtctgaactgctgttggatgaactgttgtcggatgaactcttgtttgactgcgcagccctcgaaccaagaacaccacccaagaccgcggcaagaataacaacgatagccaccaatactccgatgatgatgtacattcgtcgatgggacttaggactgggttcttctcgtactgcttctggcgcggctgctggatcaaaggatgcggccctgccgtctatggtcctgccgtcggtggtgatggtcctcccatccgacggaaatgtgctcccatcgctggctagttttgcggcatccggcccatagaatccgtacaatattttaccctcgtcaggccgcacctcgggcgccgtcgagtcatgaacgacctgcagccctgaactgtccggatactggtgactcgaaggcgcagagtattgggacatgatgccaacttcacgcggtgacgctagcgcttccggcacagtgtggaatttccacagggctgagaggaatagtaaaggagagaaaaacaaatggagaaggtgagcactgagggggaaagatagagccgggaattgcaacgttccccctgacggctgcctcgggcgcaccaggccgtcaatccttcaatcccttccaggccatctaattacaagtggtcgatcctaaaagcggactgggcgtctacaaacagcctcaattgggctatagcacatgtaatatagcaccacatcccttcagtcccaaacactaatcgaagaccgggaaaatgcaacgtgcaacttgaatggcttggccagcattttgctgctgatttcgtcacaaccaatgtatagacgttcttatctttgttttcagcatagactctccctctgaggctcttgaagatggctgcggcttttaggacccaggttacacgtacattcaaagtggtacggtgaaattggtgataacattacagtaccatgtagcgcaaagcccagcaaatcaggtgctcgaaatcagccatttcccatacctatgtcaggttagactgctcttgattatgtcagaattgtctggacggctcatcattccccgtgaagccctactcggttcagccaagccccattgccaagctgtttcaccagctgtcagccctgccaaatgtggataccaaggtaaggcacatttgcctaaccatcgcttccactggtggttcgcaccgactcaccctgatgtgcaaatggccaatcgatagtatccaaccagcagagtttcaaagccgattattttcagcaatgtattgagaaacttagaactatatgaatagctcactatcttacctactcaattaacaaaggcagcaaaggaacacgcttgtgcgacaaggtaaagcgaatcatactatcgagggcagcattataatcacctctctactgtcccctactaaatgcagattgacagaagttagattacctttcctgtgccagctacgcatcctttcatataatgcatttagtttttctctctcttatacgtagatagggttataagatggtgatacagcttccttattccttctttacggtgctatagggtagaccgctgtatcaacctagattctaagagcaataggttattgaaattactctcgattgaaatgaagaacccgggaaattacatatgtacttgattagataccatctatggctgctatacatataacaatgattcatgtcggcttaaaccagatcttgacaaccggtattctcgtccgtggctttgtgacgggaatccacgtgaccgtcgattcacggcagagcggctcttttccaaattgggtaatactccgacggccttcaacagttcccctcctaccgtcatcaactgttcaaacgcagacttgtccgcaatggatgagcaaggtattcggcggacaaggtctgtgtctaaaaagggtggcccttttcacatttggactgctgatgattttgtttccgagcaacaagtgtcagcgaaacggagggcctggcattcaactgcttgccaaagatgtcgttaccgcaaggccaaatgcattgtgagcacggcaccatcgcaactgcctaccacggtccctcgaccgccatgccaactgtgtcagcggatgaatgttgagtgtgtgtgggacacgactgataaacggaggcggaagcgtacccaagctccctctaaagaaagcaccgctgtccaaatccaaggcgtaccagatggcgaggaagcgtatcacaacaaggatcaggttgtcgcatccgaaaaagcttcttctcaactacgcattcatgatcaaaatgaagcccagcccgacaatcaccccggccatcaacccaacatgggtgagtcgaccgacgtgtcgtggtgggatgatggaagccttgatcttgggagtatctgcatccctcaagattttgtggaaaacgccaattctgaatacagctttgagttgccgcgtaattggccctcggatgttcaggatttcacgctagggctagattttattgatccatcccttgttgggcgctccccggatccagttctgcagagctttgaagctcaagctatgggcggagacaatccgatcgccaagtctcgaatcctccgtttgcgttgctacagacgactgggacctaccgcagccgcgcctggtgtacggaggctctttgtagccgttcagccatatccaaatttgccagcaggccaagggagagatgactcaagaacagaatcatcccccggtgggctttctatatctacaccacgatctacctggtcggcatacaataatctctttgattcacaagctcagagaccgcattcactcattcttcccatcattctcaacgtcttcttcgatcacttcggtgggcatttcccttttcttcaaaagcgtgttcttaattaccacgtacggactggagaagcctccagctttttgttaaatgcaatctcggctttgaccgcacgcttctgtcccttggatggcccattggcaattcttaaggatagatttaaggggaaatggcgacaaggagcccctttcttagcaaaagcaaaggaccaactggcttcgcttcttagcattccagcctccgatgttgtggctggattggtcattatggcttgggttgagtttggagacaacaacgaagcaggttagtacgagaccatggaacgatggaaaatctgctatcttgatattgaatctcacctttggtcataggaatgtggatgtattcgggaatggcaataagaatggcacaggatcttggttatcatcgtcgactcgaggcagtcgctgaccccgctcaagtgtttcgcgacttttcaaacacaaccggcgatctcaacttaacagatgaccaggcagcacttcatcaacacaaggctcagctagtcttgttctggactgcatttagcttggacgtttatgtatcacttgtcaccggtcggcccaccactcttcagagaaatgaaatcgacgctccgattccatcagccgaagacatgaatgtgacacaacttgaatggagcagctcggaccctatgagaaataggatattccccgaggttgttgcattcatgctgcatttctcagaatctctgaaaatattgaatcgaatgacgacgatgagcactgcgagcttagacggcgacgaaaatcttccctattcctcattgagggaattctctcaagctagatcgaatcttttaggacgttacaaatcgcttcctcgtcagctcaccttcggggtagatacatacaagaggtcattaaccagcagccaaagtgggctgttcattactcttcacctcttcttctacaccttcatcatacttctgtcacgcaaagatccgtgcagcactagacgaggattgcataatccttctgatgagtcgtttcagccaatcgggaatcaagaccaaggggatacgacgacgctgcatggaacccaactagaggagcagcagaatctggagatatctagaatggcttgccaaaagatggcacatatcttgacagttgcagatgtcgttcaaaaaaccggctatttggcatcacctttcacgaaccattgcttctttgtcgcagcatcatcaattttgcatgatgaagcgaagccaggtcaggtggtattccgcgatagttttatgtcatcaacgacagagaatgacttcgatctgtttaacgacaagcttagggagcaaagtgagtactttcgagctattggatccgtgctctcaaccctaatgcagcggaagaatctctcagcgggtgaagacgatggtggacagtcaactggtgatgaagatggtgataacagtttggggagggttgtcgaggatcctggaattgtaacgcggtattccatacgatgaagccgaaaaagagtggtgatgcgggtgacttcgtgactgaccatatcttgaggaaacagcgtgattacggggtatttcaaatggcgcaagcatctgaaattcatgctcaaatgggaaagagactggttagccctcaggcaaaggtggttgatatcattatatttctgcctcgcaaattagccacttccctctatacaatgatcgtgatatcatccttcatacaagcccattcctcttccgcttttgtctgcgaccatagtagcttctacctcatggtgagactcgttgtatcgcttttcgatgtcttctaagctgtggccttgtgtctctgtcatgtatattgcaataacaatggtgcctacaagtgtgaaagccgcatacagaaagtaagcaccgtacgaagactttgacagaagaatcggcgtcacaagtgcaactatatagtttgaaatctagaggtttgctatgatcagtactgaaattgatcagaaaagggacgcagaaagagaaagagaaacacacccagttgcagctctgtgcgagactcgacgcactactgcgagtttcctttggtaggctctccactagagaagaacgcaaacagacagcccatgttgcgttgtaaacgcctgcaaataggtagatggacacgattactatccatcttcctgggcctgagtcctcatgcaccgacttggcggcatacagtgaacccatgaggatcataagtatcgagatcagaacgccaccgagaatgcttgcagttctcctaccccagtgatccgcgaagacagcagccgggatagatacaatgagaatcaccagagcagagcatccagaagctaaaaaagatgccctctcaccacgtagtccggcttgtgcgaagagggttggggcgtagtataaaacgccgtcaattccagacagctgttgcaatgccatgagaaaacaaccgaaaagagttcttcctctaaagggggcatggaatgcctgtttgaagtctttatgtgtctgatgcacgacctgacggaaaaaggaggtgctcgtttccgcctgggcagttgaagtctcaaactgtgagaacatcccttcctgttccttctcgtcaagaccaagtttagtggcaatcaagcgagcctcttgaatccgcccctttgataatagccagcgtggtgaaggcggaagtacccaataggacccagatagcaaaactccgagtccacatccaagggcgggcggaatcctccatgctgcgggagattgtagacgagctgtcccgtagcaggtgaagaatcccagcacaattcccaaggccagaaaagccagcggcaaagcgttcataatgcctctagtgtggtagggagatgtctcggagatctggacccatacattgctcaggaagagaccgatgcctacaccttttgtaaggcgaccgaagatgaagcctcctaggctcggtgtgccgcactcaatggcggaaccgacaccagagattaacgagccaatggcaatgatcttgacatgcccaaagctatgggctagtggcccagcggcgagggatgttattgcaccagggatgagaacagaggagacgatgacaccgtggactgtcgcgctgaaggtgccgaaactggacgagaaggctggcatagttgtgaccgggccgatcatgccagtgtcaaatctaaccaacataaatatcttaatgacctctaaatctaggagaaaaaggccgatttgacttacccgaagagcatcgcaataagggacgctactatgccgactttaacgtaatatggtatattcagtgaccacatgatgtgagacttggattgagaggcttaagagaagatttttttttttctctttgaagaatatttgtaactgcaaagtactacatatccagcaaatttggatcagacgataattaaatacaacctggtgcctgttctcccggttgatcaatagggcaaacctccggtcccatatttctccccaatgttgacccgaaccgagaatttattttccattaatcatcaaagaagactgcctgtgatcaatatttcttctctaggaaatgccggggagagggtttgtggacactggcaggttcccttgcgcgtctacctttgaagcaatgatgcgagaagtaccgaagcgcagcgcaccctctactactatcctcgtgaaaggtgtcgtgtctgcgtctgatcgcccgcgaaactaagaatagacaggcttgatacaatgttgccagccaacaaagtcccgccaagtattacattactgtgaatccgcgtaaagtgcttctatacatcggtttattgttcccatccatacctacaaaaaccagccgattcagtcatagtcagaatgaagagaaacagtcagagatcttaacaatgcaatcgattagaacaatgtttgtccgccgtctacgataatatctgccccggtaatataccttccggcggagctggccagaaggatcaccgcgccacacaattcttcgggagatcccatgcgcccattgggattcctctcattccagatacttctcgcagcttgtaacccatctccttcgttcaaaatggtatccatatatccgggactgatgctgttgacgcgaatgccatgcaccgcccactcagcagcaagcgacttggtcattgccaaaacggcagccttggacgcgttgtacgcgacctgaggctgcgggaagttgacgcgatgggccgagatcgaggctacatggacaatggaaccgccactgcccgtcttgaccatgatgttcgcggcagccttggcacaaagaaacgaccccgtggtattgatatcaaaagtgcggcgccactccttcgcgggcatctcttttgcgtgatcgcagctaacaacgcctgcaaaggttaggaggatatcgatgccgccgaatctctccaaggcctcctgcgagactctggtaacttgcacgtcgtccgtaacgtctacttcgaaaaacaggattcgagccaaaggaaacttggacttcagagtctcaatctttcccattgaggcgggcccctgcaagtcccagatcaagagcgtgtctaggccatgttcaagcagggcctcgcaagcgacactgccgagatcaccggttcctccggtcacgactgcggtacccgagatccggaagcgagcggctgctctttctgctggagagaggtttgtaggcaatggaagtggcctgtttagctttgcctgagctgagctcagagtcatctccgggaggagccgagacgtgagctctgagcgatccatggcgacttgcgtaggtatagttagactgacgagaatggatggagtttagaagtcaatattaatcgtcgggttaagagacgcgggagatcttcttatggtcttccaaagtatgcttaacttctgaagagtgaacgggaggacatgaggtgaggggaacaaccacgttgggaaagtccgaggccttctgcccaacggatgtacaaggaccgtggtgcggggaagctccatgtcgtcaaggcatttcattcatcggtatcatgtaggaaacaatcctctcgaccttgcacacgcaattcaggagacatgctggaaattcgaaaatggttacaggaaaactgatagggacgatagctagaaattgtgacgcgtttactcgacgaatcatcgcaatcccaactgatggctttcgctgcacacggaacgggccgctaggcgcatcgcttatcaccatgttgggaaccgcctggacaaagctctgaggcgcgcaccacatcggataagctttaggtttataaaatctggccttggtctcattgcgcgtgtgatggagttgggagcaataataaacaaaggtgatcgacgcgttaggctgcgacgcgacctaccctacacatagcatgaggtatcaactttgctggggaggcataacgcccatatggtacatgctctgcatttttattaaggatattcgggaatggttcgatgaagccaccggatggttctttgggacgatggtgttaggtcttcctgtcttggccgttgcaatgttttctttctgccagtatgatgattttgatggatctccaccccctgccgatacggcgcagagagcattggggtttgggtctccggggtcgatcggcttccattccatccgcacggcccctacgaatgttcagaaattggttacggaggggctttccggaactagacagtagcccgcaaggtattgatagcccgtaccgagcctcttttagatatttagatacctgtcgagctttcctgttggctagctctgcgcagcttgtgacacaatatcagggagcataacacgaccaggaattccagcaatctctccaagtggctacggagtggggatttgttgtctctggccagaactgtcgatccccccgcaaatcccccagaacaccgagctcttgactgcgagcttgttccgggcgtggcatcggctggcaacgcgaaccttgtggattctggtcatttctagctagcagcgggcacttgtggctagaccacctgggcgatattttcgggaggattccaatgtgggtgggaagtcgtggcagagagactagatccgtctacgcgcatcgtttcggagtctccgcagctggtatgtactgaatatgagggtctagaacgccagctatttcttagtggctggctagatgctaagcacggaaaagggctggacactgcccctggctggttgtaactagtgaaaaggaggagttttctgcccttctgtcctactctggatttgttgttggcccagcacttctctaagcagccatccctttcaacagcgacctaaaatcacccctttatcccgaagcagccacaccaaagtccctctctcttcttcttctgtcatttgtcaccaaaccttgttatccgctctagctgaaatgaaggctacaattgccgtgcttggagcttttgccggtctcgcgctcgcctgcggggaggccggcttgcacatccgctcggccatggatgccgaagccagcgccgcttgtgagggcagcaacccgccaatctggtgtcctatgaaatgccaaaattgcgggggacaatactgcattgatggtttcagagcctggcaatgcaactcagacccgcatcacggcgatctgtgcccaggtggctgcgacgactgctcaccgcaccggcaacatgatgcaccaaagggatgtgtgggtggaccaacaggattgaatggtgtggtaagtgcagcttttcttttgctactgtctaaatagtctatttgctaattatgcaactaatgtaggaatgcgtaagttaaagccgactgatcttccccccaggcatctcctctcgcgtactggatatatactaacacaaatgcactcctagccacgatgttgaagcgactaaataatgaatacccgggcttccatgcctggatgctacactggataggaagcttatttggaggcgaggaataacttaggatcggtcagcaggaggtttagcttgtgacctcacatccgatcgcgcccattgtcgacgagctgaagacttggaatctcaagccggagttatatgagcagtcttgctttatttggttggcgtgcgtatttaccctatgggcacatggggtaggaatccgtgttcaagtttcatttttatgatttatgactgtgttggagccaagcgggcgataggaagatatcgtcaactaccgagataatctaagaacgttgaagcccgcagcccagcctgttcgaacgcacatacaatttgctagtaactaacatcaggaattccgtggaagccagcctggcttcgaaggcaagagtaaggttcaatcacacgatagccgcggctacgatacaacagacctagaaggatcagtttcaccgagaggggtcagttggctaggttggaaggttacaacctaactggacccgatcgtcagagccctgacctatcggctcgagcagccctgacctatcggctcgagcaaccctagccggtaggattgatcgcgaacctactgacctgacgatcaatccaatacacggcttccgtcatcaacagccccagccaaactcgaaacaccacagctaaccgggcttgcatacatcaagcaagttggcgataccttcgagcccggaactcaggctcctcgcaaggcacaacaagcacgttgccaaacgcctcctgacgaggaggtcaagccaagcggcgagttggagctgttacaagataccgagcacgagacccttacggacttcgatataatgataatctcacaacaatatgatgtacggaaggaagaggaagaggaggaagagtcagataattggaatgcaatagataagcagctacagtcacaagaaacgcaggaagagattatatgtgccctcaccacctcggaattcataggttagatacaccacaatcaaaaggaaatagccgtaacagccctcttgcgatagcctcattgaaaaagccgtgacttttggtgttgccgttgacttaacatacctacggatacacattgagggtcacccggtaaggaagttcgaatttacttagcagttagctaagaaaaagcgatatcggctaccaagcctccctcagccacagtcgcgacaggggtggggtggttgatttgacgaaaaggggtggccggttagcactctcctaaaaatgccatgagtaacgccatccgtaccacaatgtccagtacaacacgaacggtcactgcaaaggatcttattgccaccgcgaagctttcaggcgtgtttccattaaatgaaaaccccacaacaatcgtcttggaggggggaactcgcgaagaacaatagacaagtataagagttggatcgggggagcccaagtgtcatgacagagagatgggcttgaagagtgatatcaaatgcatgagcttgatcgaaatactacatgtcatgtgtgagttgagaaaaataaaaggcttggtcaacgaaaaagctgtgagaaaatacatttgcgccatatgccagatagccggacctggtaggatgtggtgtacttgcaagtttcaacaaagtctactgctgcaatctcttttagtgagggaaaaacaattatccgttgaatgtcacccaccctgccatctcaaacaagatgctcattctcacacgtaacttgaggtcatgtgatagtgctcagtcggttcgataccacttaccgcgttaaaacgcgtctaactaaaattaaatagagcgtaattctcttgccttgtttttatcgggatgaaacgttagttcacgcgtggcaattagtattttcggatcgacttagcgcggctgctgcctggaacggaaccagggttgctgtgtttgacgcgtgaagctttgctaccctacagcatcctcatcacagtatcatgtttcccatttccatgctagttagttatgccgtcacgatgtctttgaaataagatcggtttcttcaaagtataagttttccctgaaataaattggttagagccttgcacgatgactaaatggcgcttggttcgttaacccccaaaatcgcagagagcagtcctgggtccaacttatccgtctacataaataattacggtatctcagtttgggttgttcactgtcatcaagtaatcccgagaatcctggaaaagcaaaaaatccgaagctaaagtttatcacttgatatatctacatagatatgtattctattactcttccgttcgtagagtagaatttctcaatttctcatcagagtgaaaagcacaaggtggcttagacctgactcgttagtgccctgcaaccccttttgtctcaagttccgcagtggccaagcagcggctgatctgagcgccatggatgcgaggaagggctgaaagctccgtcttcattggttctagtccgcaggaaaaggggatcctactgggaaaatagtggagtgatcagccctgagctgtaaacatcatctaagtatggatacgagacgagtctgcgctgttcctctccatccaggcctttccttgtagtcgcatccaatagtggatgtaccgttgctcgaaaaattgataccatggaaaaaaattaatcggcagagcaggagaacccagcttctcctacagacgacgatggactaaccggcgcgtgaccagttgcctgccggggaagagactgccaagactaggtatccctacctcggttcccagagcttggagtgatgtgcactgggcgttgcatctccttgaagcttcgtagggagcacccaaattaggcaaacgcgttcagcaaatgaaggacgtgtatttacttagtaatcattttagtcagcggaatgcgcgtctttgattcgacagcgcgttcgcctaatttgggtgctccctacgaagcttcaaggagataagatatgctggtccaagtatgagatgatttgtccgctaccgtctggttacgtatctagaaattggccgttttgggtccccgcatactcactattacgggagaggaatgaagtttcgctcccaccaaaagtaccccatcctctggtaaaatctgacaccccggtcaaaattgaacgcggaagtgtggcaccacctgttataagtaggcccaagtgcctggtggctcccccgcggcgattcagcaccttgacaccccgcgtagacatcagacgaactgacgcagaagaacgatccatgcaaaaatgcgcttctccgctgcctgcactctgtttctaacgtcgttggtaactgctcggcccgactatggaggacaaggaaaggtcactgtttccgacctcaaacttcacaaggtcgcgatccctgtcggcttcactatccagaatctctctttcaagctgagtggagacaaagacaagaacatcgagtgttcagcagcgaatccgccatggcccgaagtctcctttatgccttgcggtaatccccactattcgtttgccctcttgccccgtgacgacagtcccgagatcctcctcatgatttaccacgatgttggtgacaggtatgtgatccgatcttcttcacaagtatgaatagcgctctgacatgggcaaatgcaggagggcggatttacgcgggggaattgttttgaacctccactgccgccgccggggcgacgagccggtcgatgatgaatgcacgcaagaccgtcccctcacttttcgtattgacggccctgttgctgactaccgctggcgcgacgcgtatgacgaattgagatagactcctggaattgataagatgtgaagctaaggatcgcgtcttcgccgtcaacaatgtgttagtctacatggcgttctgttgatccgagtttgtaataaatgaggagtgcgatgatcttggtgcttgcgaaggcgcgtgtatgctcttcgtatcgtacctcggcgtgagcttacgacaagcgatggaagacttgcgttggcgatggctgcaaacttcacatgattgaaacagagctaggttatgcggactcaacaggtcgccctgggcgaaatcaaaatgtaaacaaaacaaagaagaaaataaacgctcatgaatcagtcacaggaacaacgatctctgattttttctccccgtcccgtagttgtccaaaatagagtgtggaatgggcttttttgattctccttgaaataacactcgattcatagttgtgattgaaatgaatagacaatgcttgcaccgattcttaagcaatgagttgtggctttcatgaagcgacatcgtgacgagagagtgccgttcatgggaatattgatatttaatattggaagtggtagctctcttgcgcatcgtcccgccttcatagggatcgtgctccttatatacgactgtgtagagagatggatataatgagtccagaagccctgcgacggggtctgtatgtgaagatcatggccttcaatgaataaagtgtgcgatttactttcgcagggcaatgtatagattaataatctcggacatgttttcttttttctcgttgatttcttaatatatccattcaaattggcctcttcctcaggtggtttgggttgtttctctgtggagtgtgatagtatctatatttttaggtaaaaccttatgtttaatactgcaacttcccaccatgtattgatccggcttaactactctattcacttatctcatatttgctaaaaagatgagactattatttagtctgatgccactacatccaccagtatacgtggtagaggagcagcttggatgctgcgaagctctggtgaagtttctagcagctttcttgtcttggaatcatccaaagagaacatctcgtgaccaagatcaaggtatgcctgtgtcacgcggctgttcaattcgtcgttctccgatgctagctccagccacttctctatcgacacaaacttgaactcgccgatgcttgagttgtactgtctgagcacatcaggaagttggcgcaacgatactgcggagggattgcgaatgtggaaaacttgacttggtcccttgtctattttcgcgaacttggccagatgcaatacgctggtcgcgacgtagtcaggggtgacgaagtcaatagagatgccttcgccatgaccgaagtctgctatggctcttgtatcaaccatgctttgtaccagtttcaagaagaagtttccttcgctgtttgtggactcgtggtcaagaccggaggtacgatagatatttgtagggatgcccctttctgatgcttggcttaacagcatctccgcggcccatcgcgttttaaagtaggcaaagtcactacccgttgggaagaaatggtccggtactcgttcatctttgaagatttcgtcggatgaccctacgtccaagtattttgtcgtcttccatcgttgcaggtgagcaacactccatgatgacaagtagtggatggaacaagttgggttcatcgctgccaaacgaataaggtctcgcgtggcgaggatgttggcttgcttcaagtcgttgaaagacttgacgagcgatatctgggagccaaagtgatatattctggtagtagactggctgagcgttcggaaatcctcctcgcctaggccgaggtttggctcagctagacagcctggcgatacatcaactcggtcatgcagagatttggtatcaacaagaatcagcctatcgttttggattgtttgctcaatcaattgaagtgaaagcggagactcaattcccaagacggtaatgcgtacgttggggtggtagttgagcaggcgaacgagaaggtggcagccaaccactgaatcagcaccagtcagaagaattctgtcgctctgggttaccactctgtctcctagagaaggataatatgctgattcatccgggagcaatgcttctttctgccaatcaatgcccgacgcttcggtcaccactggggcaggtggcgtttggagtccagccttgtcagcgacaacccgagcgatcccataaggcgtcaagtcggagaacacttccctgacatcaagacttatgctaaatccccgtttgagctgagaaacaagccgtaagaccagcatactgtgaccacctaactcgaagaaactagaggacccgttgactacctgctcggccttcagctttagaacccttctgaaaatatcaatgacggcttccagaagtttgccacctttattaatttcgattgaatttgattgagtagcgtttgagttgttcgtaggaaaaacgagatccagatccatcgtcgtcagcgcccgccggtctctcttcccactgggcagtgtaggtaacgcgtctgtgacgtggtagccattgggaagcatgtaggaattgagtttggctaccaaagaggagtgaatcgcgttcacaatctcgtcgcggttagagacacggcgtgcagtcgctaggaaggctatcaactggcggtcatcaacgagctccgggtcttcagtcggcaatgccacccttcggggcacaacagcagcatcggcaacaacttcgaggttgaagtcttgaagggcttccattatcaagttttcaatttcaccgagctcgatcctgtaacctcgaagcttgatttggtgatcgcccgaaatccggcccctgtattccaattgtccatcctggagaaatcttgctcgatcgccagttctgtacagcgtcgtccagccgagccgaagaatctcatccgaagctagattgtttttgacaaaagcatgagatgttgcatcaggccgattaatgtatcctgagctgatctgaggtccaccctcgcaaagttcacccaggactgtggccgggaccggatgcaggttgggatcgaccacataatgggaacaatttggtaaaccgtagccgataggaatggcatcatccgtggatggatatgggcataggtagaaagtagtctgcactgtagcttctgttggcccgaactcattgtaaattttcagaccctcgcatcccaagtcataaacctctcgaaccagcctggcagggagcgcctcgcccgcaaatatggcagttcgataatttttacaactcctgagagactgcttgccatggagaagcatggcggcatattgggtaggagttgtgtatgtgattgtcacacctgatgttgcaagaaattttgctaggcgttctggatactggcggagttcctccttcgctagaagcatggtggcaccagaggtgagcgaaccccatatttgggacacggagacgtcccatgtgtaggatgtgagaaaaagaagtctgtcgcttggacctaactggtgtgtctcattatgtccactcagcatggcctgtacgttggactgagttaatacgacaccctttggctttccggtgcttccctgccaatgccttgagttagttgaggccgtattctaatcactatgcatctctgatgatgatagtacttggaggatgggatggagcactgactgaggtgtaaatgacataaaaagggtcatttggaaaagcttccttctgttgccaatatcccggctggtttttctcgctatccctgagatggattttgatcaaacctggcgctaaggcatcaaccaaataactaaattcgggatccaaaataacggaagacacgtttgtatcactgatcatgtgccttaatcgatctggagcaaagtttggatcaagtggtaggtaaccgcatccagcaaacgcagctccgacaagagcaataaccatgtcgatactcggcttgaacaacacgccgacggtagttccaccaatacaaccggatgcctcaagttcaagggccagtcttttcgctttagccacaacatcgtgatatgttatgatctccccgtctgacgtctcaatggccgtcgcgttggggtataaggaggcaatttcgaggattttgctcacaatcgatcgtgtttcccaaggatttggagtgactttcatgccccagcagctctcacttagatgatctagctcctttttgccacacatggagatctccgaaataggttgtcggtggtctttggccgaactggaaaggaaaacggtgaagttttctagaaatctttccatctcgttgtcattgtatagctcgggatcgtactgaagttttagttcaagaccaatcgcgggatcttcggtcgcctcgagggcaaagtcggcgggtgtagggatatcttggaaactgatatctgtaatgtcaaagtcgcaggtcgaaacgatgggtggcttgccgtatacttgatagttgacgatgatttggctaatggggaagtatgacgcacttcgattaattttcagagaatctaggatcgtttcaaatggtgacgagttgtgcgccaagctctcatttgatgcctcggaaacatggcttagcaccgagtccaaggcactgtcggcatcaagctggaggcgaagaggaatcaggttgacaaaaaagcccatcacatcactgacttcggcatgaggccgggttccatcaaccatgagaaacgtcagatcttcctcctcggtgtacctgaatatgaaggcacggaacgcagcaattaggaaatggaatggggtagccgcagaagtagcagcgattctttttattcttttcagaatcgtacttgaaacgactgctgctatcgtggatctgttcgaacttctgacctcgggtcttgatctggaggcgaaggggagcaaggcagtagcctcgggtaatccggaaagtgatttctgccaccacagaagatcatctcgaacctttctcgaatctagaaacttgttatgccagactgcgaagtcagagtacgagatacgttgaacaggaaccttggacacttcttcttttctcgcaagggaatcgtagagtgtagtaaagtggtccagaaacgtcttagtgctcccgttgtcaaggttgatgtggtggatggagaacacaagagcatgtctggtctcggaaagcttgaacaggcggactttcatagattctcccacttcgatgtcaattggccgactacgtagagagtggctagcttctgacaaagcagtatcgatatcgcgagcagaggagagatcctcgaattcaatttgagacttgaattcgctggcgagggattgctccgtgaagtcttcaccctcaaagtagattgtacgaagcgtgccgtttatcttggccatttgctccagtgtattctggagtaccgcaagttgcgggagcccgtcaatgatgaaccgagctgcgaagtttagggtgctgggatcgattgcaatattatgtaggaaccaaagccggctctggtaagtggagagagggacatgctctcgagagtcattcggcttgatctcgaattgtggcgtttttgacttcttagttttggatggttcttgagagtcatttcgttggccagactctccaattaaacccttggcttcttgctcaactcgaagagactctgcagcctttgaggttagagacttgatagacttggcgcccagtatgtcaaagagaggcacgtctagagatgcctctgtcaagaaccacttgcggaactcgattgctacaatagaatccaggccataagcagtgagcggctgagcttgctggattgattctgctggagtgcccataacggccgcaactttgttaatgaatgcagctgtaagaagttctatccgctcgtccaatgacgccgtcgacttcaatgtagccaacaatgtcttagatgattggccatccccggctgaagaaaaatcgaggttggcatagaggtttctgaacagagacttggtggcccagtagacgtccttgcgtttcgtgttgattccagatataatctggtgggcaccaacaccaaatttgcttgccggtcgctttgatgtaagaattgcctcctcgatttggtagaaaagctcattttgtgagatcgacccataaccgagtctctcaagaacaacggctaaggagctatcttctgcgacggcgcctacatctcccaccacaccaacattcatcgtggctccagcgaggcctttggctcttcgatgggccatcagcgcgtcaaggtaggagttggcggccgcgtaattggcctgacccacggacccaataaccgaggatatcgaagaaaagcatacgaagaaatccagatcaagattttgggttgcgaggtggaggttttgagtgcctcttgttttagggtgaacacattcacgccacatagcggcagtcatctggtcgaacggcccatcccggagcaccatggctgcttggaagacaccccccaaagtgtgtctcaatgaattaacacaggctgctacatcctcctgacgagtagcgtcgattttgaaaacggaagtttcgacgcctcggtcatgaagccacgcgatcgttgcttttgcttcgttgctcttgtctccagagcgagacaagaatgccaacttgcgagctccacgacggaacatccattccgaaagagatctgccaattccacccaggccacctaccaataagtaagttttgcctggcttgaataagggtttatttgtaaaggacatggggaccaagggaacaagctccctctcatctggcttaaggatgatcttcccaaagaattttcccatttgaagagtacggaacgctttctgggcttggccatatgtgaagacctggataggcccaggaggctggatttcgcctcgctcaatgagagtgaatgctgtccgtagttgctggctaagcagttccggggccacgtggaataatgtgatggcgtcgacgcttgcgtatgaaatgttccgacggaatgggtccatatccagtttcgagttttcgtgaatgtcacgctttccaatttctatcaggcgccctagaggtgcgagagacttccaggtggcttgaagcagttctcctgcaagactgtttagaacaacatcacatccgcgaccatttgttacggccatgactccttccacaaacgagtcatctctagaggagaatatgacgtcgtcagatagaccaaatctatccttgaggaactgccgcttttcaggagaacccacagtggcaatgacctttgcaccggctcttaatgctaattggacggccatttggccgacacctcccgcagctgcatggaccaagcaatactcgcctgcttgaagacggccaacagtgtgcagagagtagtacgcggtgactaagaccagaggaaaagccgcagctgttgtgaagtccatttcgccgatcttctggcagaggatggcagggttgcgtatcaaggttctatgggctccttggcccggacggaatgcaatgaccctgtctccaggcttgaagtcattctttgatacagatttgcctgtgcggacaaccacgccagcagcttcgtcgccaaggcggttatcgtcaataatcccaatagaagcagccacatctcggaagttgagggcagatgcttctaccttgacctcgatatgatcatctgggagagacaagtttgccgtatcttcgtcatcgtcaaatgcgagagtgtccagaagacccgtcttgccaatcttcaaggagaggtttcgatctttctggttgaaattcgcaagcttcactttccggttcccgccaaacagtaatttggaatcctttgcttcatccgactgaacacgaggtatataaagtcgtcctccccgctcagccaactcctcctcattcttgaacttgaaaagagtctgcaaaatcctgtgagcgacattggcctcagcaccattttgtggatcttcaaagtcaactgtggcaatgcgaatgtcatcgtgttcactgcgaatgttgcgaagcaatccggtggtaattgcttgcgagggcttgcttgattcgatagttgcaccataagtggcccaaacgatgttggtagcgacccctttgatgagtgttttgatcgattgaaggtgaccctcctcttgctggggctcgaacaatacatcaacatccagattgactaacgaaacgacattgctgctggtgggctgctctttgccgaatgtcaatatctcgaattttccagaatgaagtcgctttagactggatataacgccctttgccaattcagatgcttctggagagataagcacagaaatagggacctgcgaatctacttcctgggctaagtcggatgcttgccacgcggttatggtgtcattcgagaaagctttagtgaggctgcctggagctgagaaagacttgtcggaaatgaggtatccgttcggctttagaaagttctcgtggctcaaagaagaatgctcgtcgacaataatcaagtcatagctttcagtatctggcttgacgtgtttgatgaggccgtgatgttctgcgccccgactttctgcaacagaagctgcatcccatgtttgactttcggaccaaatgttgagattgttgaactttcttttctctgaacctgaccccccaagaaattccaagattctttctacacgatctttgttggaacctagatataagatgtttgcatctggggtttcgtggacaaacagttcaacaatgtgggccagatcatattcttgaataagtggctggtttgttccgaactgcgaaaataacggcttccaagatatattgaaaaacagttccctcttttggccggcatctgcagaatcgcttcctaaagccgtcacttcgagtccatcgattgaaaccaggacgttataagcttcagaggtggcattatttgacacaacacggaggttgctatgagcgactcttgtacctggcatgtctgtcgtgcagtcaacaaggaaagtctgcccatggtcagattccttgacttgaacaaggtcaccggaaaacacggcgttccgaataaacgtgggcacaaaactttcatttagaggttgccctaagcaagactcaatggaagcaaaaaggacatggaaagctgagtccaagaaggcgggatgtactatgcagcgatctgcagctgaggcgaccaagggagagggatcgaactccaatgtgccaaccgacactcctgggccgctgtcgatatctcctttaagcagccgaaagtcatctccatactgaaggccgatggattgcagttgcttataatagagcgaagccggcttacgtcgatcggtcgcgttgttgatcttggctctttcgtccctggaaaggaccctggtgcggctttcagaccccaaacccgctcggatctggccgcggcaatgctcaacaagacgatctccatcaccatacgaggatacgcaaaacaaataccacgtactcgaggtgctcttcgctgatactgtcaaaggttggatctccagcagaacctcggtgccggcgtcgttggatgtaagaacaagtgcattcttgaacacaacgtctcgtatttgaaagcccgtggttgagtctgtgatggtagagacggcctcaagcgccatggagatgtatccagcagcagggaagatgacctttccctgtatgcagtggccatttagccaagggatctcggatagacggagatagtttctccatatcggtctctggttctggctccccggtactacggccccgagaagtgtgtgacgcgagtttcgaagccggtgttggcggatgggccgtgtttctgcccaatgagacccatgatcccacccgtaacttgggaggtcgtgtagtaatttgcctggagtgtgcttggcaacgtctcctgtatttgagtccagccaaaaattactattcactgcctccaagtctacgttgtacccatagctgaacaattcgccagcacaagcaatcaagctttcaaaagctggtgcatctcgtgttagcgatgcgacatatggcagggaaaatccaagagcctttgcaacatctcttgaaggccctttgagagcggggtgcgctccgatttcgaccaatatatcaacatcttgctcctcgttctcgtcaattagcatgccggtgagagcatcagcaaatcgtacgactccagtcatgtttgctgcccagtagcttgcatccatcttgcgagctgacgagtcccgggctgtgacactggataccattcggagagatgcatccgaaggcctgaagttcggaatcctagaaagtgcagcctcaaaccccggggccaagcgggccatgtgatgcgaatgaaaggcctgctcaactctcaggcggcggttaaacacaccgcgcgagtccagttctgacttcagctccaatacggcgtctacatccccagatagtgtgaggctggtaggactgttcacagctgcaagggcaactcgtcccttgaacggctgcagagctgataacccttcctgctgggtcattcccaccgcaagcattgcccctcgctcggatgtaccgtaagacatatacaagcctcggtagtatgcacaaattatagtacttcggaaggagaggatgcctgcagcatatgccgccacgatctcgcctgatgaatgtcccacgacagcacgtggtatgataccccacgctcgaaggatctcgatgatgcctagctggagggcagcacaaagtggttgggagataagactctcgccgagccttgtgtcttctttcgactttgtcaactcagcaacacaggtccattctgggcgatcgggcagctcggacaagatccgatcacagcgctcaatggtctgccggaacaagggcagcttctgtaagagctctctgcccatggcatgccattgggcgccttgtcctgtgaaaatgaatcccagtcgaggcgacttgcccatcggggaattccatgtggtgatgttatccaagccatgaatgagcgcttccatattggatccaatggcaaaggatcgcaactggagcctggaccgcctgaagctgtagctgaatgcaatatcggggaccgagataggagacccagatttgctactcaggtactcccgaatatgggcaacattcttcgtggcagcacgtttattatgcacagagagggggagaaggtagggacgcacttttgcgtcttcatctaagtgactagcaggatcgtgtgtcggcaatattgaggccattgaccgacccgatgagtaattctcgataatagcatgtgaattggagcctccatagccaaaggagttgatagaagctcgccgtattggcttgtcatgcggccagtccgtgacctcagttggaactttgattttcaacagtttgaagtcgatatcggggttgggtgtttcgaaatgcatattgggcagaatctttcctgtggatactgacatcacagctttgacgacacctgcgagtccagatgctccctccaagtgacccaagtttgacttgatagagccgacatataaaggcgtatctctggtggaagcaaacacggatccaattgcattagcttcaataggatcaccagcttttgtacccgtcccatgagcctcgacgtagtcggtatcagctatttcaagataagaatctttgtatatctgacgtatgagcctggcctgggctgccccgtttggaagggtgagcccagctttggaaccgtcgtgatttgagccagtacctcggacaatggccttgatagggtcaccggcggcttctgcgctgctttggcgtttcagcacaagtgcacagactccttcgccacggacgtaaccagatccattcttatcaaaggtacggcatcggccgtcagtagaaagcattccgaaatcagtcatggtgatgtaaatgttgggatcaaagtgtaatgcagagccagcgacgatggcgatatcagattctccttcggcaacagaccggtttccgagatgaaagcagacaagagacgatgagcaggcagtatctattgtcatacttgggccgtgaagatcgtagaagtaggagatccggttagaaaggacggcgtttccagtacctgtaacggtatacttggggtatgtcacaagatctttggtcgtcatggagttgtagtcattcgtaaaggatccaacgtacaccgaagtacgagaacccttgatagattcgagaggaataccggctgaaatggaagttagtgatccgcttattgtccattcgtttgggagccataccatcttccagtgcctcgtacactacttcaaggagcagccgctgctgggggtccattgatttggcctcctgcttagaaatatgaaagaactcattatcaaattgagacaaaggctcatccaggaagtacccatatcgagcatttgtctaatgtcaaaaaagaaataatcagtgtttggtcaaattgattgatgctttgaattcttaccgttcctttgtttgtgcccagtggatggtaaaaggcatcaacattgaaccggtccttcggaatcttttgttgtagatccttacgagtgacgacgttatcccataactgaggcaggcttttggctccgggaaagcgaaacgccaacccagtaatgacagtgggatcagtggaggggcctagactctgactaccatctggtccgatggaggtagcggacgactgtgggcgagagggactgctcccgttgcccttgtccgaggagggaacagagctgagtaatgtagacattgcctacgtgactcggattgaaaaatacaaacacttcgttattttctcgctctattgctcctccttttcaaggtgtgatggccagtgaggtgatgggaggcagagatcgaattttataaacgtagctaggagaagactgaagagcctgagccggatgatgtctttttagtttaagggggaaatatttacaagttgtctacgaatacaataattaatcgaggattaaatagagaatgatatgagagaagcccccggccgacttcgcttagccgtaccgtccatcacgattcaatatcctcggcatctcctggaccaaaagccagatcaacgtgtaaatcaatgcagaaggtaaaactgtagatctcaacaaaggatccctcctctgccgcgtcaaatgagggatattcgatgtagttgtcgccatcaaccgtatcacgtatgaccggggagggtcaaattgtgcgatccatacgtctatgctctcacgaggaaagtaacaatattgcatgcaggaactggattggggtttgcctacatgctggctgctgagtcgtataggccatcaagtttctgggcatcgttatgtgcattgcggcaaagcaatagaatcaatttcgcagagctgggccagatcttgtaactatcaccggtgtggttacgtaaatttttactaccaaccgacgaggtgagtttattcctataaccggaataaacaataagtgaataagcgagatggatacgtcactgaaggtacctcggtctacaagaattactggatgaagaatgccatgcggccagggttgccctagttgtggagttggacacgagggtatgcaggagtagggaaggatccgttacattcgaccttgttgaccgtctgacatattgagcatcatctttgtcacatcatatctcgtaacaatgtcgcattcacggatgtgatgggccccagctgaggaaaatcaattcatgcttctccacggtggatcgagcctggcatcggtgatcatattggatcctacatgccttaagcgcagacgtcataagcggtatgattccgcacggttaagcatttgagcgttatgataggggtgggtggcagttccttcatcaaaggctgagatccggtatacgggcatcactgattgcaacttgaagtaagctgtactgtgaggtctcccccttcctcgccaggcgcaaagttcgatcatggccttctaccaagccactattcctcctctaccggactctctccgcctcgatggccaaaccgctgttctcacaggagcgacagctgggatcggcctcgagctttctctccagcttctgtctcgtggcttaaggcaccttattgtcggcgttcgcgacgtccaaaaagggggcgtcacccgccttgatcttctctccaacccaaaggttgtgaagaataatcccaatgcccaaattacagtgctcaagctcgacctctcaagcctagaaagcgttgcaaagttttccaatgaagttttgaccatcacttcacgccttgactgccttattttgtgcgctggaatcaacactgcgcacttcgaacagactggcgacggaaatgagcggtatgcaacgcgggcctgtttttgtatctgtcatggaatctttttagtactgaccgatgcctctcagatgttttcaagtcaatgttttatcaaacttcttgatccagatgcttcttttaccattggtgcagtcgactgctcgagagtttcatgatgcttcatccccacaacagcctcccactatcacatgggttgggtccatgggacaagcttttcatacccccgctctggggagcgacaatgggaatcaaggcgccattctccaggcatatgcgtctaaggaacgttattctggtatcagaagatacccagataccaagcttttcgtgtccatgattagccaggagttggcctcccgcatcccagagagtgaagtcattgtcaacaatgtgtgccctggaacagtgaagacaggagctgataataatcttccattctatctacgaatcccaatgaacttcaatcgttttttgagaggtcgtagcgtggaagatggtgctcgcgcagttttctgggcagcgagaggcggcctccacaaagaccagcccaacggcttttatgtcgcggacaaccatcctcaagagttagttctacctcagattgaagaccatctattaatttactgataagaagtattgatttaggccctctgtttttatcaatacgccagagggacagaagtttgctaagaagctatgggatgagctcatcttagagggcagaaaatgggatgctaaagtaggcaacggactggtggcttaattatagcgcagttcaatacactctttaggtcatttaaatttaaccatcgatcatcgagccgtctgaaattactatcatggttacttgtgcggaaggcaggtgtaaagttctatgagtgcctctgcgcctcaccattccaaagagaggagctagggttgctatgaaaacataatggatattagtcggatgaattaagacttcacagatggactgtagttagaatggcatgcccattgactacgggaggtgaggagagaggtctaaagaaacatgaactaagtagaaatcctacgaggatcaattggaaccccaacaatttcttttatttgtcacctaaactcaatctactcgctacctctatagccactacatttctgtcacatcgatagctctaaccgcaacggtaaagcacaacccctttggaagccccttagggcgtcagtcgtatagcctgtcaccaagcgagatcgaactattcatcactctcctcttggtggatgccttgttcagtttcgtgttccctgtcgagactgatatgcttgacaaagaagctcccaatcatggctgctccactgagcgcacacataacggcccacacaatcttcaaggaatctgcataagcctgtaccagctcctccttcttcacgtcattaggcatgtcgtggagaaatgatacaatcgagctggcgtctcggctatattcaaccgccttgtcagccaaggtcgtagtggcgagcaggttggatctcatttggttctggaatatgagtccagaaagggccacgcccaatgcctgtccaagcattcgtgagaaaatgaacatggatatagcatgtgacatgagcttgtccggcgctgcagcctgattaatgatggccagggaggtgtagagtagcccctggccaattcccatgaagatggtcaggaaaaaccattcggcaatagtggtatctacatccaacagtgtcatgacccccaatccaatagtgctcatgatccagccaatccaagtgacccagcgatactcaccacgcttggatataacggtccccgctaccattgacatgggtgccagagtgaacgtggcggggaatagagcaacgccggagatgatggggctatagccctggacagcctcgaagtacaacgggaggaagtacagcgagccgtagacaatggcagcgttgatgatacccgacaacaagctgtagagcatctcatagctcttcagaagactcatcgtcataattggctcttttggaacgtatgattcataaatgccgaacgcgaacaatacggcaatgccaagcaacaatgggaaaagcgtctgccactgatcccactcatactggacaccaccccaagtcaacggcataagcgtgcaggtggcggcgccaacgaagacaaggctcccaagccaatcgaactgtctcagcttatcgatgacagaccccggtggtttcgaaagacgcaagaatatggggatcaagaccaggacaatcgcggcaaacggaataagcatccaaaagatgcccctccaactcgcctcataggcaagggcaccgccgataacggggccgcacacactcccaaacgcccagacgccccctactattccaaagtactttccgcgttgtctcatgggcacaagatcggtgacgacgatgtcgttgagcaggatgatgccaccgccacccaccccctgaatgacgcgaccggcgaagactgtgccgaagtccttggcaacggaggcgacgatgacgccgatcaggaagaggaaagaacatgcaacgagtactggcatacggccaaatatgcctgaccacgccgctgtcggcagctgaagtactgccgagctgagaaggaagctcgtgccggtccagaacgcttcgatcgctgtgcccccaagatcatttgccataatctgcaatgcccgaggttagcgaggatgaatcatcatcgacagttgctggaaatatttgcatatatcgaggcgcttacgggtaaagctaccgtcacggcagttccgtctaacgacaccattgctgcaagaacaaggatgggtgccaaggccagccagaatcttctatctggcttgaactctgcactcggttcggcggcctccgctcctccgtcagcggcctcaagctcgaggttgttggatatagatccagaagtaaggtcctcaatttggctcttctcttgggttcgctcaacgcgatttgaagccatggtctcgggcatgatgtatagcttggcagctgtactaggtgtctcacacaattcagtaggtcttggtaccaattcaatgaagtaaatgttcggaagcatgaagttacaggagctaacaatctttctcccttttcgcagccgggttaatgtagacgctggatacggcgattcgttcctcaccaacaaagctaagctaggagttagatttctaatccgtagcccctgctattccatctaattcgtcgagttgcatattttctctcatgacgtgggaacatttctaatcaaattaactatcgaatggcatcatatcaaccgaatcttgcaacagccactcagggatctttgtcaaactctttcaaaggatctgcaagcatgaataataagacagcggaatgaagaggtcataatgcaacaaatgaaacgtctactagggtcacatccaacagatcctatgtgtgctgtaccaggggcccctgagccgatcacaatccaagtatacgaatagcccaatttcagggctcgggagggcccggatggccgaaaggtctccttatatgcagggcccaggatacgggcggaagcattccgccttgctaagtcggtaacagttgcacttgatccttacatgccgcgcctcgattattgcaaatactaccataggctctttgcagtaagttacttcgtggtccctccttcgatgacgcccctaagtgggttgcagaggcgcagggcatctttgtatgcagctgaacccacagtaagcacgggaagactggaccgcttcgcatctacgcgatgctcctggtccccggaattagatcgtcacatcgccctaggaagctagcgcccgtcttgccgacaaggccattcaggatgggtgcaacggttatactgtgggcaataaacagtgtccacaaggtgggcgagtgacatctgaacggtttgagactcacaatgtaaaaggaaagggggtctaaatctccaatattgcacgctgcaagccgggtccattagccctacggaaaaaagtcctcatttcgcttcaccttagctgcttcaaacatatcgcaatggcatctaggcctcttcaaattgccatcataggcgctggtcctgcaggctgtacactcgctcgccttcttcaggtctctgagcaagccagcgccgtcaaggtgaccatctttgaaagagaggcccagcttcatgatcgagatcaaggcggaacgctagatctccacgactcgacaggcctagaggccttgaaacgcgctgagctcctcgacactgacgagttccgggctatcgctcgccatgacggcgatgctatcgtcctctgtgacaagaatatgcgcaggtggattgacattgccagcagctcggacggaggctggcttgctcaaggcaaacctgaagttgatcggttgcagctgcggcagttgcttctgaacagcttggttggagacgtcgtggtctggaataagcgagtcagtaaagttgaacctgctacagacacaagttccaccttgtatttcgaggatgggtcgtccaagtccggcttcgacttggtcattggcgcagatggcgcctacagcatcgttcgctccctgatcactcctcaaaagccattttacagcggagttgggggctggaacatgctctgccataaagccgacattcttcgtccgctcatgaacaagatgatcaatcggggtagcctatttgcattctcggacggcaaggtcgtgatgggtcagcaactaggcacaggctcaatatacatcagtatgtggggtctcaagcccgaaaactggatgtcaagttcaggctacgacgtcaaagacccaaaacatgtcaagaaggctctcctggaagaattcaaggactgggcccctgagcttcgagagttgctcgcgtcttttgatgaaacgcaagtgtggccccgtagccttgttatgctaccaacaggcctcatatgggactccaagccaggactcacgataatgggcgatgctgctcatgtcatgtgtcctttcgttggtgaaggagtgaatgccgctatggctgatgcgatggaactcgctgatgcgatcaaggatacaattaagagcggctggagcagggagtcacttgcgcaaaatgtcgaaaagtacgaacatggaatgcgcaaacggactctccgcgcttcttccatgacggaagatatcatgaagctgatgcttttcaccccaggcgcccctaccactacaatcgcacggtattttgtgagagcaacaagcgatgatcttcctttcttgctccgaccagtttggaaatttttggtcaacttctactactttgcatttaaagcatttttcaagtaattagcatgtatttagtaatacaaatatgtatccactgatctcgaagctttttatacatgaatataatgcatctcaaagcagatgctccaggtaaaggatagaagttgcgtacaatttgctctgccattctcacagatcgaaccctctacatgtatccacttattaaaaatgtgctcaggatgaatctaccctagcctgatgatagtcgtaaagaaattatcaatgatattgaggttgcagcagaggggatctcgatgatgggctgagaattgcccaataatggccacgtgaatcatctaaatctatttcattacccggttgacataggaatcgaatgtcaacccaccgctatcggtaattcggagactccggttaatgactcactggtatggataatgttgtattccattcaaccgaattctttcttcctccaggcaatgttgatcgcgatctcttccctatgtttccatccaagtggattatcatctgatatggcattatttattcccacttaggctcaatgagttaacccacctcagccccaattttcagggcggcgtgttgaaccgagtcttacgcttgatgacccctggccaccgggcgtaggttgcattgtgcggcgaatcgactattgcgtgctacccgtgccagggatcccagaggcctcgtttacacaccctagataattgcatctacctcgagtattcaatcttcgggtagatgaatttgtatcacaatgttgacgtctgcatcacatggctacgcctttacttctataccataaatagccctgcgattcgaattatactatgcttgtcagccctcattaacgaatgaaaagctttgacaaccatcataagactttcacaattcattctagtgatctcatccagccaaaggttcataagtaatcgtaatggccttcaagaccgttctccaagccatttacagcccactgggcttcacaaaagcatatgcctttacactgtgtacgtttgcaaaaccccagtccatttgtgaagaccttgggactaatgtccactactgagagaagggttcatcgtcagtgttgcgctcgttgggtttatcctggcacgtctgcaatttcttgacattgatggccgtctgtgtccagccgtaccggccaacgatggttcctctggctttccagcagcgtgctactggattgttcatttcaggcggtaccgtgtagccatgattcttcacctggccacctcactgcctgcaggtctcattgccgtttttcagttcttgcctgcaataagacataagtgcatcttgtaccatcgcatcgcaggctatattgccatcacactgggtttcattggcaacattggcgcctgcatgcttgcagacacggccatgggcggggagttctctatgcagactttgatcggatttatagcatttgtcacaaccctcacccttgccatggcggtgtacaacatcaaaaagctccagcttgacggccaccgcgcatggatgattcggtcctgggtctacatgggatttgtcgtgacactccgaatcatccagccaaccatggccaacatcgtcacaaaatggccatcggcagcaaagtatgtagctgtgtcgtgcaaagaactacactacatatactttgcgggccaaaagctaggacaaggcacatatacgcaggatagcctggacaaattcaaggcggactaccccccttgcgcggaacatcctctagctgagaaagtttatgttgcggtacagggcgtcctgtcacctgacgacccaggaaaagtcaacgtcgctctcatgtcgacgtttgctgcttccggtgttttcgcattcctgcttcacgcggtttgcgccgagatatatatttggcttacaccggcagagaacgctaggctacgtgaagtgagttatcaaaggcagcttagaagggggttccccaacccaggcagtgaaggccttgtggcccaaagatttggcgacgcgcgagaatgggtgccggatgcatcgtcagagtctcctgaaacccagtccaatgaagggaaagcgcagtcatagataagaaaatgaatcattcttgtgacattcgttttcttgagagatgctagtatactgtttgagaaaggaaagagggtggtataggttctaatgctcttttggcagcatcagggaatgaagcagcaatagttaggctctctaaagctctggaaagtgttcataggatcaaaggtgatatactctaatcttttgtgtagaattgtaaactacgatgcctcactagaaaaatcctagataaatcctgccattaatcttcttgaagtctccatagttcaccatcctttttgcacatcccctcccactgacggcgcagaactagccagatgaaccaatttactacgatgcacacgacagaatccatgatttcaagatctctctttggggaagcttcaaccatattggtgaaaaacaacgaggcggctagcgaatccctgcagataatatattcctcattcttcacagcctcaagcactagtgagactaccttttccggcgagggataccgtttttccaagtcctcgatggacccttttaccccttgcatagatttagtaagagaagtcttggtgtttttttttttggcttttcactatagacaaggggcacagtatggacgacttgaacacaaagggaaaatgaagaggatcaacatatgggaagaagcgatttacgaagctaaaggtcattatacaatttaagatcaagccagcacgtaaatgtctctaaaactttgatgaagataaaattctatgattatagaagagtttaaatgaataaacttggaaaaagagaagatatgtatatgtaaaaggtaaaatataaacaagaagaagaatagaatacggcagggtatccttttatttgaatttattatttgccaacttcagttaaacaagctgactggcagcaaagatgacagtcagaacaacaaacagtcctgtgcctgccacatgggatgcgccactgggaatgacagatgacgaaacagagccctgggttgcggaggctgaaccgctcgctcccgaggtacccgagttggtgggcgtgatgctgccggtagaagtcacgaatccactccgggttgagctgtcggaagcatcactgcttgcagaatcagtctggctcgaggttccactcgcattgctcgatgttgctgtcacgctactggaggcggaggtagcggtagtgcttgagccaatggaatccggcttgcgcatagaggcgccagggcatttggtgatacactcatagaccaatttgtataagctcttgtaagcatctttatcttgagactgctggttcttcttgaggtcatcaaaatactggtcgtcgcatttgcgggcacatgcgtacgaagagcacggggcagtatcgccgtcgatgaaactgagacctcccttctccgccttgccccagctaccggtggcaccctccagggagaattggccgctgtacttgtagccagaagagccgctgttcttgtccttgttttgcttgagctccagggtggtgatggcgaacgtggcatcgctggggaataggtcgccagggatgttaaccttgacggaagtggtgtcgatcttgtttcccttcgagagcaagcaggtaggcatcaaccctgaagaggcaggtggtgcagtcgccaggtagacattgaagttggagtaggcggcatcgaccgagctcgagccgttactgaggtcgttggtgatctggacttcgaagtcggtgttggccttgatgttggagggaatgctgattttctcaaatgccaatgccgggagggcagcggcgagaacaacgagggcagtagatgcgtacataatgaagattggtaaatggaagaaaaagaagaggaagaagaggaagaaaactttagaaaaatgaagaaaggggtattctctgaagatcaaatttagaaaaagacttttatgaacgaaaaaagtatgatcgtgtgatcaaagtcggaaaattgacagaagaattgaagtatttgaagtctgaaaaaaagccacgaggggcgttgaagaagtgaaaagaaatgaaataaggaaaaaagaagaaggaaaagagaagttctcactgagagtggtgaggaataaacctagacttgctgtgaaggcagcgtggcattttataatatacatttccgcgatgattccattcactcaacggtgctgtttattctgagaacacattcgggaactaacaatagcacctcgtagcttaatttcctgccagtcacggacgccgggagccctggctcgctccattcaggtgcctacctactttttgcggtggttcatgctatttttagagaggatcggctcctacggacatttttgattcgcgctccgtgcccgagacaacatagtctgtttgcgtcacgtgagacaggtagctcagactggaacgatgtgtttaggcatgatccgacttgctcgtcttagaatagaggtcttgcaacttcgcgaccgacagagcgtgcggcgatctcagatttgcaagcataggtttgccgcgatgtaaatagcctaagtacgcgtaaatggtcagctcagactccctcggaatgatgctaccctataccatagatcatttcgcccaagtcttaagatagcccatctagctctgataatttatagttagctttatatatagctttcttgttgatttgaagttatctattatctatgagctctcttgtgtgaataacttagagttcaattggaatgaagtaaaagggccgagactgcataaattgctacggtctccaattaactacactcatgctctttccatatctttgcacttccccgtgaacaacaaacttcagtaatcaaagtgtgcaaaaagaaattaaagaaatctccatttaccttagattggctcttgcttcgaggtttgcttcttgtctgccttttctccaaggacaagttggctctcggaagctttcaaaattgctccattcgtcgcgttgtctgtttattttacgcgtgttggatccacttatcaacacgttctcatttgccaacccttattggcccctgacactacgtacctagccatcatcaatatcgtttgaatagctctgccatgatgcctcacctattcttctcctcaagcccaatgtgcatacttgacccagtcgataccattttcgggacaagccgggccgccaacctcacgaaccgaggtgggcgcgtgtcaaccggagggccgtggggtatgcgagaaggctgcgtggtacgaaccgcccggttcccgcggacgtttcaacggctggtttggaaatggtccttccgatatcccttgagaaattgtatgaaccggcacgctgcttcgacttctgcagctccgtctgatacccagctgtagaccgccgatacaatatcggcaggaaactcaagctgtccaagatagaatcgacaaaggtcggcgtgatttcaaaatgtgggtcgcccggagagaaatcccggaagatggtctcgccgaaacaccacatgtcgacggcctaggaatttgagcatctgctgttcccatcggtaaagccaagcagctctgcggactcgaatcgcgtgttcctcgtactgctgtggttttaggaacctgatcgcgtctggtaatgctaaaggcgccgagtatgaccaaccacgcgtcggtaggtggctttggatgagaatattttggtgatgatggctaatagtcagagaatactattccactaaacgccttagcgacataagagagttggattcacagctggatcccgatgagcgaaattctcctcgtgcaccctggagactgcatctagcacctgggaagtaatctatctttaggcaagcggctgtcgggacattagtttgcaacatacttctctagatcactgagtgcacagtactccatggtaatgaagagcttgttcccctggacaaaccatctaaaggtctttactacaaatagttccccgtactgaagtcacctgtcagtatttgtataagagcgaatacagaggtctaacctactctgatttgggaaaagcttgatgatagcttcaagctcgcgcacgtagaaatcttgattggaatctagctcggcctcggggatgcgaatgcactcgacagctcggtgttaaggtttacgctgggcgtggctttccgtgacctgcaagtcgacggactgctttgatttactgcacaatatgctgaatcgaagatcgttcgcttgactgatcgattgtgttttggtagtctctataggtgagtcttgtagctatactcacgcggtataagggtattaattatatatagcctgtaatagatcacccctcgcgaagctgcttaaactagagacattttagtgataatatatatatatatatattagaagaattaggcaaggaaaagtattgaacattagactgctaataaggatctggatataatatgatggttaatttcctcatttatttcccaaaatattttctgtgccttagctgtacagcctacgcgtccttggaattctctcttcaaaagccgtctttgcgcaagtagtaagagaggtcctcttcattggcatccttccaagtaatgccatttccaaagaagaagtaacgatttggactgagatatttgatatcgtagtcctcagcacgttgcacacccatgagttccttgaagtgaagagggcttcccgcccacatagtggtgactgggccatggaccttgttgtttttgtaccatgaacggcagtgggaggtatacaccgtacgcttcagatactcctgtgtgtatacattaaagtcctcaatggcttgttgcttagggtcgatggaatgaatgtgctccttggccatcttctcaatccatttggctgcatagagcccagcccactccatctgcgggatcaaacttccattgcccacggctgtaaggcagaaatgttagtatagagtactggttgaactcagggacagacttacgtgagtttggccctagaatgaagaagaagttggggaagtgtctcgcagtgacactcatgtaagattccgggttctctttccactcctccttcagcgacttcccaccacggccaatgacgggccactgcttggcaaaggagacgtcaaagccagtggcacagatgattgcgtcgacttcgtgcctattaccgtccgcatcaatgacaccatcctctgtgaactccgatacggaattgaaaaccgttttaacattgggctccaacagcgcttcaaggtaaccgtcgccagggctcagtcgacggcatccgaaagcccaggttggaatcaacttctcggtgaactctttctttccttgaagcctctcattcataatcttcagggaggcctccttgaaatattcctgttcaggcgacccgtattgcagacccttgtagagcttgttgaagtcgtgctcgatcttcttacggtaagcaagcagcttttccgggtcttcgaaatccttgagctgttcctcggaataagtgaagtttttgccatctgcactagcaaattgagcagcgaaattgggactgatccaggtaggcgagcggatgaaggtggtcagctgcttaacgataggctggatgcttggcaggatctggatggccgaggagccgttcccaatgagcgcaactctcttgttggtgaagtcataatcgtgatcccatgcggcggagtgcacccggtggcctttgaacttatcaagacccttaacatttggccacttccagttgctgtttcttgttagcagggtgtggagtacattcctgagggaggctgaacgacgtacttgagcacaccgctggcattaatgatcacatccgccttatcctcgatgagcttgccatcgatctcaattttgacggtccacttcccgtcatcctcgacccactccgcatgtacaactctggcattaaacttgacgtctctatccaagttatactctcgagtgacgtcttggatgtgttttcggatctctggcccgtttgcatagaatcgagtccactctgcaagccaagacgatagagattagttgaccgtctgcctacatgagagcgataagggttgactgacttggatttggaccccatgtgaacgtatagatgtgtgcaggcacgtcacaggccacgccggggtattggttttcataccacgtgcccccaacctcgggattcttctcgtagatgacgtggtccacgtagtcctccatcttcagctcatatcgaaactgcaaagtcacgtgaggattttttcttttttgcatagcctgttggaggaggaggaggaattaccttttgagctaccatcaagcctgagaaaccagctccgatagtgattacacgaagctttcgtggcgtgaacaaaggttcttcatgcacgggaatccagttcgcaggtttgggtagaggctcgccgttgtgtgctgaaccctggttccgaacccactcgattggagtgggagcagcactgtcaagattgttggtggtagcggcgggcgacatgttgaagatggtaagaaagtatcttgatattagctagcaggaggtttgaattcaagtgataagattctcagtaattccccaatgttgataccgtccacttattaaacggttcatctagtgatctgaggtttgctatcgccagtctaatccgttacagtccctccagttcacgtgcaccagagtagaaacattcttggttccgcccccaagttttctccacgcttaaacccgtgtcagtgacggaacaacggaacgatgagtcttgccccacatctgcagattccttgagctgaagtgattaagacggaacaaagtcccgcgctctttcttatgtcttatttcgtcctccgaagattcgcttcttttgcgggcgaagcgccgatgatctcttgctcggcagcttgcaaaggcgtttttgggattcacaactccgacagacccttatgggaagaaagagacttcttgatgtcgtaattatttgttcctagtatatacatcttgcaactataagaaatccttgagaactgaagcaaggtctgccccatttccgagcatgaaattatcactggatgcccactgattgctattgaatgagttctgatctccaaatgtgtttgctgattcccccatggcctcgtacatgtccattagttcccgactcatctgtgctccatccacctgcaaattgtcatcttgtaagcatgtttgggtgcctgatacgggagcaccaattgattcacggctgtctgccatgttagcagtcgggactggctcctgtggcccagacacctgcccttggctcaagaagctcatctggggagcgagctgccggagatgtctgattgacctccagagtcttcgcgagacataggattccatcgaaaatccctctacaagctccagcgccatatagaactcgtctttggagcaggtactgaattgggccggggcgtgagccgcggcgagaaagagaactgctactgcggagactagaaaccaattgaaggccacttgttgcagtctatatatgtcgcacaccttattgagatgatttaggtgccgtatggaagctttggcaatgtccacaactgtcgaggcttccacgagatgctgagaaatatgctctgctctcagaagaatgggtcgtcggactaggatcctaatcatgttaccgcgtaggtatagtaaacttttgagacgccaaatccttcggttcgtatcgtttaccgaacactcttcgatggattcgggaaaaggcagcctcaactgttctggaatcgattcataccattgcatggcctgccaatcgagaaagctcatctcctcgactcggacggcgtaatcagtacttgcccccccggcgaacctccatgctttctgcgcaatccgacaatagtcgatcatagaattcaggtagggctcaccagtcttgacttgcgtgttaataaaagaataaaaaaccagcagcaattcgcactacttactggccgagggagcgtgggctcaatgtccatgaagtccagatggttgggcattcctgtgcccatgctccatctcacatccagagcatagacagaccagaaaagcctagaagctttatgttccccgagggtgacgatgccagcttcagaatatgtttcagctctgtgcaaacccaattccatgcacatgcgttgcaccatgccaatcatcctccatgccagcgcctcttcgtctatttgaaagaaaaatatagactaagagtagaatgttagacattacactcgccctctcgtttcctcggcatgattcgcgctcattggacgtagtagacgcattggactcaccacaagagtgacgataattgccgtctggatgtcagcaggccgccacatcaagttagccagggcatctctcacgtttctaaatatcctcatggctagctcgctgcgtccgctgttctccgcagtcaaagcgcatgcaaagaccatcttaatgatgttgatgtcctcatctttgatgataggtacaggtgatggtggcgctctcgaggaggatagggacccgagatggtcgtatagcctgttcacttgggtaatggtcgactccagctctattaccgggtacatggtgcccatctcatcttggtatacccggcatagtcgaagggcctcctccctaccaatcgcccagaagggctcgacgggcggcgaaaagaacggtaaaagttcatcctggtgcagcggaatggacggcgaggctacaggagttggctcttgcgtgaagtctccaggcctctccaaccctgtgattcctctatcccggagactcttcctggcgatgccgagatcaaagattgatgtggttggcccgtggaatgagggggcacgtgttgggcgcatcctgtcgcggttgggggtagacgcgagtccgggtagaaactcgggtcgccaatctggcgaggttgaagacggccttgccgacaggctctcaacgcgagattggagagactggacctgctggaggagcttttcgatgtttctagtttctctcggtcaagcctgttcataagtacgggcacaagacacctactggctgtcagaattgacgttgtcggcagcgtactcgcactccaattcatggtgctggcaccgctcacatggctgctggccgccgcatttgatcttgcggcgcttgcactctttgctaaagaatctcaaatcaatcagggctcaaccgaaggccaagagcaatggaggggactcttcgaacaggcacatattatcgagtcggagttgcggtttacttaccacgctttgttgacatacttagtccgtttccgcttctcgggtatcgtgctcgtcgtgttattctctggctgcgacgctggggggcccattgttacttccggctcacaatatttgcagagtcgtttgcaagtaggtaggtaggtaggtgatgagctggggaaagaatgtttttttcgggaggggagcgttttcccttagaatccgggggaacatggagatgcggggaagaagggctgttagcctgaagagtcaacctatcacggccttgagattaaaatcgcgacaattcccgtgctgatttgacatgagtcgccattcgttagtcgcccccctatcgatcgctgcgtttatggccctcttttcctgatatagcgagtgccggtgggggttttcaaccatcaacaccacaaccggcgcctgcgagaggtcggtgatcgcgatctcggcgccggtcaacaggaagaagtataaccaagctatataattaaaactaattactataattggttattcgtggactcctatatttaatcaattgtaaaagtgtctaggtcttgataagctagagtgaacatagaagaatcagttcaagattatcattttaagagtaaaatgaaagcagaaggtaagaattttcatgctatcctgtttcctaactacgtttgtttcctataccctggcttagaatcacgccaatgttattcattctccccttctcgatcatgcactgcaagcccttctgattattctacgcatggttagccattatacatacctctgcctagattagacaaaacgaatatcgggaaaagcaagggttaaagatatttatagttgctttgttgagtgcatgcacatagacttgttgtagatgcaattgataatagatactactgatcttcatcgttcgcaccctcttctagcatttacgctatgtggctacatatgagacatccttaagtctgcacaatgcttaaagcctgtaacacttgttagcgacagcgtcctcatttggaaaagggatcttggttacttgatatgaatcgtatttctctggagatagtcgtgtagagcatatttgctagactcgcgacctccgttaccactttgcttaaatccactaaaggccgttgacgggcttggcaggaaagcagagttgactgccactgttccgctttcgattttagatgccactcgtaaagcgcgggaaatattctcggtgtataggcatgctgtactctctggttaatgcaagcacgctgcttggtctagttggattgccatctacctgataaaccgtattctgtgttattagccagtgctatgacttcgtcttctgtcctgaatgtcttgataacgacgactggtccgaatatctcttcgcggtatattcttgcatctgaggatggatcaaggaatatagtaggctcgataaaaaagccccgtgttcattctgcttaccgccagtcactagctgcgctgtcctttccccgtctttgataaagtcaagtacgcgattgaattgtatgctgtcagcaacaggcctaagcactgtctgcggatcgaggggagactgtccgagcgttctattggctccctcaaagttggctttcagtccaaccacaaactctgagacaacactctcatgcacgtagacacgactagcggctgtggcactggtaagcgtcttggagtttttccccaaacagtagcggtcgacataccagcgcaaacttgtcccgaatttaggagaaagccttgtgaaattctaatacagtccaattcagtactgagttagctgctcgggcgagcacgagtgaggaggggactcacgccgacattgccttatcaaggcccgcatcgtcgaatatgatcgctgggctcttgcctcttagttctaatgtcaccctcttcagattgctcttggtggcggcttcttggactttccttccaacagctaccgagccagtgaagcttatctttcgaattttctgatggctcgctagcagctggtcagtctccccgcctccggttactaggttgataacactaggaggaaagctagcctttataaaaagtcgccccagagttagcgcccccagcggtgatttctcagatgccttaaaaatgacctgaattggacacccttctcagcacatgactgcgtgttagtaggatagtgcgggttattcacttacagtattgccggtggctaatgctggggcgatcttctacccgaaatatctgctattggttagcagaaagtaaagaacaggtttgatgttgggcattggccagatacagtgcggttgtgttccatgaggcaatagaggcaactatccccagtggctcgttctggaacaatcttgtatacgccatcatcagcgggaaaagcacccccttccagcttgtcggcgtatccggcgtaatctgaatcggtgcgtcaataaacgaaatccaaggcattttagggcaccatggaagctgagacctacagtggaagtaagaaacagccacgctggcaaacatcctggaaacagaaattggaatccccattgacccggtttctaggctcgaaacctggtcaaggtggtcgttgagtaggtcggcgaatttgtgcagtaggtcgcctcgctgagctcccgttagagatcgccatgggccgttaaatgctgcagttgccgccgctacagcgtcgtctatgtcttcggatccagcaacttgaatgttagaggctacaaggctatcatcggcagggtttcgaatttcgaaggtgtttccagacttcgcatccacatactttttgagacaaagacatcagcgcggtaccaaagcgtctccatcttctttttttttttttttttttttttttttttttttttttttttttttttttttttttttttttttttttttttttttttnnnnnnnnnnnnnnnnnnnnnnnnnnnnnnnnnnnnnnnnnnnnnnnnnnttttattttatttttattttttattttttttttttacgtcaaaactaaggtcaaggcaaaataaggataagaaaatttaatacatacacagcatgtctcaacaggtttcaaaggtagtgtacaaattactttcgaactaagtctggtattacctcgagtaacaagagatatattatttatgaagcaaaaattatcacggttctatattttctgtgctagctccatttgtttggataatctgacgaagcaggacgctcgccaacactgccttgttaatgtcccaacatcgccaaatacttgttgttttgtctatgggttcaaagactggcgcctcacaaggcttactgggtgggacgctcggacccctcaaccttggccctggcctcaccggggttggccgagctgcaaagttcgcttcttatagcatgcgaggagccttctttgatgcgccggcgccatagagggcatggtagcccatgactcccagggccccgatggcgaggacaccaaagaaataagctggcccaagagccaggatgctgaagatgttggaggcgccgaggcggcttttgccgaacgccagaccacggttgggtgacatgttcccgaagaaataaaaccccacattggaccagccatccatcaagatgatccagccaatccattcggcagtcgagtcgggcatatcaatgtagggcaacccgagcgcggagacaataaccatgaaggcattggcagcggggccagtatggcaccgcagccagccggcctcatctccccaaaggccgaattcgagaacgaagccgggaatgatctcaaacccgccgatgatgtacatccacagaccaacgccgcccaagaggcaggacatgagcatccaagatccatggccaatcatctggcgtcggagagcggcgactttcggagacactgtcatagtggaatggaaaagtcgaagatattgtatatatgatgtgtaaggagaggctgtagggcttgtggatgctgagaggggaagaagaattcttgccaatgtagaagtcagaagcagagtgtaaggataaagggcgagtgttgggtgaaggtgaggcaaaatataataaggaggacagctccaagactatgattttattttcaagctgcactcagttgcacagtgacaaatcgccgtgggcccattggacagggagcatttcgcggggtagatgtgggggaagttgggacaaaaggcctgtcttgatgatgtgtgccgctgccgagagttgtcgagtcatgcttcatcatctgataatggcaagatctgtcgtgggagtaacagagcggttgaatttcccgggtggggctcagcttaagcggaatgactttgcggttgtgagtggtgcggactcaggtgatgtatcgcggaatgcccttccgttttatgtggccataaccatgtcatagtatgctctttggagccacgacaggcggagacatggcgaatgaagacggaatattgacgctgacggcatcggtctcgcggtgcattccgcagggtacctgcggttcgtctagccctgtaggcggggataagtctttaataaattgcctcgagatgggtctctcctgcgtaatgtattgagcagctcttgagcagcgtaccaacgacctctaaggatggaaatgtagaggagagagacatgaggcaacaggagtatgtaggggcaatgcaaagagtaggcaggcagcatcaatcattcaagtcaatttcctatcaactaggataggggtaagtaactaaatatattttgaaacacatttattgcctggggaaaacctcacccatatcacaatacccagcgggccgggactaaaacctagttccctgaaatctaagcattgttgagcaaaaacagtagcccaggcaatgaccacataattaccagcacacattaaatacaagatctacagcttagccaggcctagatttataggtagatatcctaatgtttgtggaaaggattgaattcatacttgaggtgatcttgctgagtgccttgtggaagctgacagtatttcaactgcatacgaaactggtgaagtattgtcccaagcttctttgcttactccacggtcatgaggcttctgacaagcaaaatttactaaaacaaatttatggattgcccgctcttgtcgcagctctggcattgatggcaaatgaagaggcctacagggcaattcaacatctcgagctgaggagaggagtcatcgcgggttctctgagcgacctgcgtactgagatttttgacctttgaacaattcttactgccaccttcagagcacgagctaaacttagctgcaactgagggcccgattattatcatcagcacaatttctaaacgctctgatgcacttatcattcacagcgaccgaatcagctctttaaggctatcagaactgcactatcatattgcaagtgaatatgcgaacaagcctgagattgatcatgagacgtttgaatggctttgggacaccgtcgctgaaccgatcctggagaacttgggttaacttgacatacctacagagtcaccttggccatgtattttctgaatccccactcctcgcgatcagtggatggagggcaaagaggatgaaatggatgtaagaggtgggaaagaggggaggatagggggcggcgggtagaacaaaccggctcctcagcgagcaggggaagacggaccaagggagaacagagatatatttgcttgcgaagaggccaatggagtgggttccgtttgtttactttgggatatagtcctatgctccaggtaattcaatagtaggtatgctcctgttggtaagcccacggccttctaaattgtagtcgtgcaaaatctaacatatatgctcgtgtggcaaactacaatgcaaacatacatagcctagagaggaaagactaggtagttaatatgtaggatctctagaataaactgatcatgattgcgtgtattgcaaatgccgtaaaaggtaccaacgtaaacgaatgctcttactgattggggaggcaacagtaaaatattacctggtacatgctgcatacgacgtgatttctcttgattactctctacctgctgaaggcaacgtgtccaactgtggggcacaaaagtaccgctcagaaccattgaggctcaccgattctagccattcccactttgcttccacgcatcatcctcgtcctcttcatcacgaatcgccatgttacaccgactcagccccgaactcatcgctctcattcttgacagactcattgagggcgaacctggggatcgccctgctccacgtcggttgaacttgtcaagctatgcaaccatatctcgtacctggcagtgggctgtcgaggcgcgcacatttgcctacatacgcgcccgcaatgaccctgggtacattgatatgttcaaagccaatctggcaggccggaggcatctcgtacgggccgttagcctcaaaatatccctgcctaccgaaggctgctcgaggcagaattacgcacaggaccacgaggtctttgcctccacaatagacatctttatgaacgagctccatcaatgggagcgcgatggtgatagttctggcgcttctcccctgggcctgtctgtttttcttgactctaagggcagacctggaagaggctctagtctcgccaaataccgctttccatctctcacagatgatgaggctagcaggttgccaaccttacgacgtgtgacgtctctccatatccacacggctcaccgggcgatgcatcctcgggccgtgtttatgctcaccgctgccatgccgtgcctcgaggagttggcaatccgccactacgaccctcgtcagcacgacaagaaccgggaggcccggcttgaccacagggcggccttcgtatccggtatttcagaactaagggcacgcggtaatctcagacgtctgcagattgcgtatgaggcgcaatctcttgccacaaaccacgacttcagtgaacgatccttcgaagatgagcaaggcgtggacccgctcagcgaggagatccgtctcttgtcccaaggcccgaaattcgaggagttggaacttgaccatgttcccatctctcttgatctcttctacaacacccgaaagggcgacctcgctgctgccgcacagagggaggagggcatctgggagaacctgcgcaagtttgatatcattctcacgatgcgggatgcgggcggtaggtggtacttcaccggtacccgccccgacggtgaggacggttgggtatcctctgggtcagagtatatagaggacagcgactttgagggctccgagccggagacgaggcctcgacagctggttgtggacgaggagaacccatactctgcctggcggacggagcttagcccggagaccttgaaccccctgtttacgcatctttcgggggcattgaggcgcatgcccaagctggcatcaggctacatccaagccgtgcccctacatggggaggacatatatcttcagcttagtgaggatgaccgaagctttgagttcgtacacgatcctaacagcacatgggtgccgccacctgaggctatcaatatgctggaaggtgccggatggagggcgaagaatcacacttgaactataagagtctcaagcaagtaagtccctcgactaaagcgttctcagggaatgtgggcaccaggcaatcagatgtactaaggtgatgtttcaggttgtgagtttaacatggctgtagctccagggtgccgaaaattgtgcccgttactcttcttagcttggttatttcctgtggcaactctaatagtcgcgaggcacctgggaggaattaaagatttcacgtcactaaatgggtcgtagggccgactcgatcctgatgacaaccaatcatatttctggaataatgtaatcgaatatacagaaaccagttacatgacattgagaaaatccgttgtttacgccgtggtaggagtaagcccgaaggatgctgtggaacatggtgcaacgttgtccagtaatttgagtattacgtgtctggaaagtcattccacagaattatcttgagcaggttatgattaaaagcatgtcactctgaaccttctcatttgttgtattctggaatgtccccagctgctattcttggtgcattgtggcgcctgttcttgagttttcgggggaacttttttgtggctcttatggatggattgattctagaaagacgaaaccggcttgttcgtcccagtgcatggctcttggcttacagcttatcctgtttgaatggcctagcgtggcgtttaacctctaattttggctttggatagggctggttttgaaccgacaatcgctccgaagctagtgaagatcaagggttgttggcttgggctagcgtctaagggctgtttacttgttctcgtgatcttctcaagctacagcttgttgcactacgttttgcctgtctaatgttcaatctcgtaacttagaaattgccgagggcaattcagagaattcgtcatcagtcgtcgtcatcagtagtcatcgtagtgggaactcagaacgaacacggcttgtcctcgatttcgatttcaccgaggatctctagtgctggcgagcaagcagaagttcagctcatactattctgggtatcttacaacaagtataagaggaatacgtttcccagtctctgaacacacctttcaaaccaccaacaataacaacaaccaacaaccaacaaatcaaatcaacaacaccaaccctagcactaagactcctctgcaaatatttccaccatctcttttcaacatgaagttcctcgctaccgtcgtcctcttcgctgccacctccatggctactgcggcacccgcccccgacgtcaatgacgaaggaagcaacggccaatgccagaatgttgggcagcgctgcaactacagcattcacccggcgctcgcttgttgccccgggctccagtgctacacccctcccggatctcctcctggtgcctatggatacgtatgtcaaggccgtcccagccagagccacatattggtttagtactaacttttcttttttgaagtgccgcaagaactgagatacatgagagttaattgggatttgattgagaagaatagagacgaggaaaaacgagagagagaacaatcgctctagacccctgcatcccaatacacgattttggatagaaggacgccttgggataggtttttgtgccctgtttagaagaattggctttgggttttccctatctcaatttacaaatgtagaggcgaagttttagttcgtttaattgacttttattgatatttaaagtaaccaatccaccagtgaactaatgtcaagaagaagtttgttaagtatctgggtatctcagaggggtttgaaaaaaaacaacaacattaacatgcaaaatataagggcaatacttctaggtctgataaaaaaaacttatatatcgaaagaattgggttttttttcatatccacgaggaagccggatatctaaattcaaaagctctctataagtggcaaggtgaacatcacatagtgcctcacatcaatacttacgttctaggtatttattacgtttatattcaactgaaagctctaagcgagtcaattttacataggtttaagggacgtttggattatggtccatctgagggacactattgcaatctatctacagtgaggggaggaacttcgctttcctcatcctttcccacgaccgcacgtacccctcggctgtatcaatctgctcgccaaaaccgacagagcgtgaggccgaaagatcatactgcctgtcaaaatcgaaatctaccagcatgaagtgagtgtggccccatccctgctcgtcgacaagcttctcattcaacccatttcgcttggcgacctttcgccatacgtctttgttcttctcaatgaactctagcataggtgtagcattggcgtccgagctgccgccgaccaggccaaaatgctcacaaagcttcggccacacctgggcccaggttaccgtcttcccgtcggcgacgttgaagactccaccatcgccacatttctcaggatgaagggcagcaaatatttccatcctggacaacacatcctggaaggtgtctgagtgggtggaatggtacccgtgttcatagcctgggaaagggaccgtggcccccgcacccttgacttccttgtacaaggtgagatagattgcaataccttgtgccatgttcatcgcgttcgatcctggggcaaatcccacaatcccgtcagggcggatctcgctaaacgtccatttcttcccacgtgacagatccttgagcaggtcatactgggtgtagtagaaaattttgctggcccacggttctgggatccgagggcaatcctcctttagtggtggctgaatctttacatcctttggaaattcaaggccgtatctgtcggaatgtcagcattgaagggtgaaatacgaggacctgagcacccctaccccttgcctcctgtctgcaggatgagcactttgaactctggcgctactttctctacagcttccactgcaaccttgagcaggttggtatttgccaccttgagagactcgtgatcctgagtctggatgtatgctgcaattttgtcagatatcggccggcagcggaagtcgtttccggctatcacatacctgtaaagaatacatgcgtcacagtaccaatgtctggaatcttctccttgagtgtggctgccacttcgtgggcgctttttgtcaaattaatgccatctgcaatttgaatgcgatcatctcttggaatctgcagctgctcaagtgtggtcggccggtttgtcgtgccggtgatacgagcaaaggcagtttcagaggggtacgttcgagcttggttgagaagcgaccagccagagatgccggaagcgccgaagattaaagcgtgtgccattgtcggatacgctgagcctttgatgcgtagcaatgtgtagtacggtattgattctgtaccgagcagaaagaagcccttttatcgtgggatacccagcaccaatactacaatattcagaagagggtattattaatccaataccagtatttgaacagcatgacgccaccatcatcgagaagtggataaacgtgttgaggaagaactggacattctccgtttaattgtagcaagtcaggggctgattggctgagacatcggaaagcagaatccgtgtccgactggagcagcgactgtggccacagaacaacccttcctccactttgtctcgttgaaattgatatcgaatggagggtagagggccgataatcaatgaaatgaaaatgtctgacgaaggacatcatttgccaaacgtgaagttgtgtttagtacaaggcgcgcatggcatggcacaactggatagctgggacatagacgagtaggttcggtgaggctaccgaggtcacagtgtaagtagacgaggttgagttgatatgaaatcttattcaaatgaaagccgatgatttgttctatgccttgaagtagaggcgaagggacgcgaatataatgcagaactcaaattgatctacgaggcaacaagtaaaaagaagttcttcttagatcgaattctacactatcgaaaccgtctgatcttaaagttttacaaagagatgcctaccgaatcgttgcgttcagatatgggtttgggagagaggccaggtgggcagatattcccactctgctgagcccgtagatagccgctgtagatgccaacaatacaaacaggggggccgagctctgcagccagcgacggaagctgtttatgaaccatagtttgtcgccgccctttcgaataaacgctttgtggtcagtgaagagggtggcgagccagaactcgatggccatcccaggccaagacgcagcattgcgcccaaactctccaatataccaattggtgcatttgccggagaatacactgttacggagcttcaagtgaatttcgttggtggtgcggttctctactgtctccttgacctcgacgacgttggccttcccatcgataagaggcctcaccagtgccctcgcggcgtaatctacctggacctcgcacgcgtacagggccgagttattcgcagggaatgtgtttggaccaaatctgctctagttagccaagcacagcgtttcgtggatcatggatcttacaggatggcaaggttaggaaagttgtgcacaaaggtcccgaggtacgcctgcgctccccggcactcattccattgctgttgaagggtgttgccatcggcgccgacaatttccatgggcgtcagaaactgtgagactttgaagccagtggcgagaacaatgatatcatactcatcttctcttcccgaggagctaatgatcccggtctcggtgatcctctgaagaccctcagggataagctcaatgttgtctcggtgaagtgcctcgagataacctgggtcggcaatctttcgcttacacccaagctcaaagtcaggcgtgaggattgtgtggtatttctctggcgccttgtggcggatatagtctcgagccacttcctcttctttcaagcgctgctggacaccagcgtctgtcccacggtacgcatacgactgcttgtcgatggaccagaagatgttccaacggcgcaggcgcatgaggagagggacagttcggaacagccacttctcaaagcctgtgaagtgacggttggggcgctcatgataccattggggactgcgggcatactgtttgacgtactcagccttctcagacaatgcaggaacgacctggacggcgctgcacccgtttccaatgacagcctagacagttacacctattagctagctggacatgagatgttccaattcacggttgcacctaccaccctcttcccagcgtaggacacatcgtggcgccattgtgcggtatgatagatcggacccctgaagttctccattccttcgaagtgaaccttgatgatcgatgttaaataggacccatgccaatgaagatgactgtgacatacctctcgcggtacggagattccgccgactgccgatatgaacattgtggtagtccgtgtgaattctatgcccgtcttgagatccctcaggcggacttgccactgatttttggaggaatcctattctgagccgatgcattccactccgagattgatatgagggcgtaggttaaatttatccactgtatcttcaatgtactgcaggatctcttcctgctcagctagctccttcgaccagtctggatttaggttgaaactgaaggagtacagagttgactgaacatcgcatccactgcgtcaatatgtcaggaaagtcatgctcaataaagatcatggatgtggtgtgttggttgctccgaacggtaggttgatggggaaattagaaaagaggaagcttgggccaaaaagtacataccaaccaggatacgaattcgctcgccaagtccccccgacaccgtccatcttctcgtaaattgtgaagtcgtcgaactgaagctcatgctttagtttgtgggccatggcaacgccagatggcccagcgccaatgatgattgcggagattggcataaccgtcttgatgattttctcgtaaggattttaggatacgcgaaaaaagaagttgtagaatttacaatgagttacaaaaatgaaagaatgctgctcgcggcgatgaagattttggaaagtactcccaggtctatgtgcaataccagaaagccatcgaatacgccatacgacgctgttcgattccgatactggccgctacatcgggaaattgcgattgtatggaaatgaacgactggatgggaagcatagtccgcgaatcaaggttcggaatctacttcccggtgcagcgcttgctctgacaaagccggtcttgagacagatctccactgacctgtttatgccaagaactagtgatcgagaaaagtccgactaagtgttataaagaatgaacggaattagtagggcgacaaaaacggtgcgcatgtattcgcaatccatcaagaaacggaggcgccgatgtcaggaatcatgcttgctcaggagctgcacgcagcgaaggacctcaggctggtatgtttttaccccttttgcaaatatccacaggattgggaaagaaaagaaaagaatgtatttgaagagcgtactgaaacctgttgacacgcatttcaccggcttattaggtgaggaggtcgattgaacctcccgcagaggacgaggtgcagattgcaatgagagcaactacactctgtggttctgatctacattatttcacccattttgccaatggagactttaagataagagagcctctctctccaggtcacgaatgttctggtgtgattgtttctcttggcgcggctgccgagaagaaccgtgacctcaaagttggcgacagagttgcggtagaggttggcgtgccgtgcggcgactgtgatcgttgcgcagagggcacgtacaacgtctgtggaaagctcaggtttcgaagtagtgccacagctttcccccattatcaaggcacgctgcagcagcggttcaatcatccggcgcagtgggttcacaagtaagccatctgcttcacaaaggtcaagtgatgatgttggtagctgaccgggcagattgcccgaaactatatcgttcgccgaaggtgctctccttgagccgttggccgttgccattcatgctgtgcgtaaagcagatgcgaagaatggcgccagctgcctggtcgttggagcgggtgccgtgggacttctctgcgcggccgttgccaggagcttcgggtatcgacatatcgtgctgaccgacattgtccaaaacagactcgattttgcactctctaatggctttgccgacgcggctgtaaaacttccagctcggaggtctagtaccgctgaggaagatctggcctttgcaaaagaagacgcagagaccttgcgtaagcagaacggcgacaaggcattcgacaggacatttgagtgtacaggcgtcgaatcctgcgtgagaacgtcgatatatgtaagtatggtccggaattcttgaggctatagtgaaaaagctgacccactgccaaaggccactcgcaacgggggcaagatactcctcgtcggtatgggaacaccgatccagacgctgcctatatcggccgcagcactgcgcgaagttgattttatcggtgtttggcgttatgcaaactgctatcctcgtggcatagaattgatggagcatgcaggccgggagggcatcccggatctgaagaagctcatcacgcattctttccaaggcttagaggaagctggtgctgcctttgacatggccgcaaagacttgcgatgaagaggggaaattagtgatcaaggtagtactagaaaatgccgagtagtagaagggatgcacctgccattgccttgttagacgaattttacgtctcattgtgatgacctcggaccttcagcttcacgcaactactcgatcagtgttctgaatgttttcggtggccatcggaatttgcacgagcacgattcctggctcgacatcgggtaatggttcacccactcactggattcatcatcaagttcaatgtattttaatcaagacatcccgtagctggagccgaaataaatattttgacagatgacatcaacagttagggaaccatgatggaagaaagggtcagaaaaagcagatcatagatctatctaattgactttaacttcaattgtttgtagtctaggtagttcataatctagatttgcatccatctagactgccttgctcccgctcccgcaagagccacgagatagttcttcaccttctcaactatgcccttggtgtcgagaccaaatctgtcgtccttgctcttatttgaggctgagtatccaaatccagtaattccaatgctggcggttgcgtatcttgcctagaccgtggccacaaactcctccacgctgacgacacgggcttgtcatccagtggaaacaccgacgccttgtactcggcgctctgcttttcgaacatgtccaggctcggcgcactgaccaagcgcacagaaatgccctcgctggccaaaatatcggcagcagcaacagcaaaatggagatttgatccgcagcttgcaagtgtgagatggaagtcatttggctctcggatcacgtatcctccgcgggatacctgtttcctatctgtgttcggcacgtatcccaccgggtctcgggcgagagaaagcattgaaggactcctgtaactctcaagagcatatatccagcagccaataagctaagctcttcggcatcgcaaggacggaagtatgtcagtcctggcatggcacggaagagtgaacccacctccacatccaccagctggtgggtgggtccattctgccctccctcaaacttcatgagtaactttcattcgacgagccgctgtcctccgcacgaaggttcatagaattttcttccgtatgactgcatcttgggcggaccgggaaagactatattttcaagctttcgtattcattgcgttaagttgttgggccctggcagcttcattgtcattaaacttcatttttctttctcttctgtatattctggctttcgcgctagacgaagaaagttttcttacgcttggcggtaaccttctgcttagggtataaagacacccaaagggcgatttccaggacccaaccaggagtcccgctctttccatcagaagtccccctctttccatcagaagtttacttctttctatccgaagtccacctctttccaccagaagtccatctcattccaccagaagcccgtctctttccaccgaagctcaaaatcatgggccacaaacacagcaagccatccgaggatccaggaggtacaggcagcacccgaggtgagcaagcagcaggtcataacatagtggctcacacttacatttgatttgatcagcaacgaagccgaaattccatccaccagggcagcagcctccagcatatgataactgcgacaagacggcatggttgccccgagagaatgttctgctgatcatcgagaatatgaatataatcatgaaagaggtagtgggtgaactggataatgaactcgacggttcttccgatgtgcttgtggctttaggccatattcgcgagagctgtactgtggctgcaagaacagttaccaaaactatgctcccaaacataacgcataaatctctcgttagtgatttatacgaatgcagtgctagacttgaagaactgtctcagtctcttgtcagggatgtagcagtggataaagaagtggcagtcatcctgatctctgctaatgcggttacaaaggctgcctatatggccaggtcaaccagtaaggactaccgtacaggaacatgggctgctgtaataggtataacgatgcacaggatcggcgcgagaattgcttcgagaaagtataaaagtctagctcaagatctggccgtctgaaaacggtgtcttgggccaggtgtttcttgagcatgtattaagggattacagggttgaatacataaacgttctgcccccatttagggttggtacgagattgagatgagcgtgaacctacctacctaggaataagaatcgaatggcagtgatggttacttatccgtaaaggtctatctttccagcatgacagagatgagatcgtcgtgaagcaagagccacctccagtacgagcagcgatgtctgccgatgtgatcgatttgtgaggcaaaagaataaggatctgcatagccaggtgtatttctcatctaattgagggcggtataacctggcgtgtttggacgatcggctagaggaaatgatgaagcttgactccattatgagatgcgtgatcatccaagtgtaatgaaatactcaaaactggtaagcgagcttctgcttacattatcaaatagacgtataaaatagacgttttcaattccgagaagcaatattgttgttgattcccaagcttattggacttgtcactcatatttacggcgtatttagacgccaagcacaaactgctgcctgaacttttccgatgttagcagcaagattgcatgcgttgaacagcaagagcgacgatatgctttcaaggagaggtcagcgattctttcccgagattaatgccagcatagtagaaggaaccatgatcgtgtgtcaggcgtccgggaggacatgccagttttgacgctcgcgcctgacacgtcaattggtcatcacatgctaacaaggaccaattcacgggctcccttatttacaacaactgctgcacttactggcagtcgacaatttgctcaactgcccaacatgagttcagatatcccccgggtggcacactgggtagggcaaagtaggagttcgcatctcaaatctccctataggtaatttgcacgtcatcctgaacggtgaactcctgatctgatgaaagatccggtacacttagaaaccccaggggatgtcacgggtgagtagagtcttagtctttatatttggtagccttgaaagatggttcttgcattatccaagtggtttcccgcttcccatcttagagtatctctgtgtttattgcataaagcctggcttctggcactcgtgcatgacccaaggaagcatatttagatagctacgaaggaacggtctggttcatgtcatgttggttcactcctgcccatttcatgatctcggggtgtaaacatgatttcgtggaatcttctccttatcctcttctctcttcttttccacaacatacgcacacacacacacacacacacacacacacacacacacacacactcacacacacacacaacagcagcagcagcagcagcaccaccaccaccaccaccaccatcaccaccaccatcatcaccagcatgacgcctgtggagacggccgggctggtgagcctcgtgtgttggggtgtccacgcgtttcggggtcggcggcggcgcctccaccacgccgacccaagggagaggaaagggctctccgatcttgtgtggcgcggccggacccggctggctggggccgtcgcctcggtcgcctcggccatcgcgccgggtccgaccggcgggttgaggaggacctcgggggggagagggccgggggagcagggggcggaggaggaggggctttccccggccccctccctgctgacgagtttgtttgagacttttttttttgtgttttttttgtattgtttttttgttgttttttttgtttgttttttgttgtttttttgtgttttttgtgtgtgttttttgtctcggttttttttttctttttgaatcatgaacaggattgggttctctgtgcatctgattcctcgtgatgaattttctgtggatttgtgaccatgtcgccaactgtcacccatgatagggcccaaccaaagcaaaagacattctgactaaagtagaacccacatgtcgtcgttgtagatcaacttgaagtgaaggcggtgcaaagtaggtctgtgccaccgggctcagcatgcgcaagtgcgcgaaatcggtttggggcccaatggcaggtcacgcagggcgacgcgtctcggtctggcggcagctgcggttcctggtcgtctttgatcgcccggcgccaggtcatggacagacgagggtgcgagacatgggaggtgagtgtctaaaatgcccatatgtccttcacttgctcaattgatacccatagcgagagttcatatcttgactcacgggcttttctgtttcagtctactaaaatacccttctacaacaagctgctccgcaccaggctgaatgcatagcttagtgttcgtctgaatagagggggaaacgccgtgtcgaggtggccccaggttattattttactactgttcaacctacatgctagatctgcacaatctaactcactaatacaactcaattaagcttgattaagcttaattctagtacagttttagctcagatctcgctccgtttatataatcattatttagttttaagaacagaagtggtttttggtgagattattttccagtatcggttgttgttgtgcaactaaaatagcctaccggcaaaaggcccctaccttcgatcttgaatattactaatattaaacagattctgttggaccgaatgaccgcttggccaaaacgttcacccgttataggccttgtatttattacacctgataaccggtctaagaagagttagatatagaaatattaaagatatagtctgtattactctctctctagaggggggctaatttctattatttatatacccgctggatgaaagtgtgatattttgatttatcttatggtgttgaaggttcgggtatgggctgctaatagtgttttttctttttctttttaaaaagaaagtgtgtctgttggtgccaagcgggcgatagagagatatcgtcaactaccgagataatccatgaaggttgaaacccgcagcccagcctgttcgaacgcacatacaatttactagcaaataccatcaggaattccgtggaagccggaccggccgcgcttgcaaaagtaaggttcaatcgcacgatagccgcggccgtgatgcaaccgacttagaaggattagtttcactgagaggggtcaattagtcaggttggaaggttgcaacctaactggacccgatcgtcaaggcactgacctatcggctcgagcaatcctagccagtgggatctatcgcgaactacggctctgacgatcaaccgaagaccgagttatcggcgcaggcccgatagctcgaagaccgttctgatcctatcaaacgcacaagttgaaagaaggtcgcaacctcggtctaacggatatgaagatccctaactaactatatgccaacgggataattgacggaccttacaagtccgagaccgggctgctcgcgtgaggatacgatcaagggattccttgggatataagggtcaacggatccctcctgtaattactagttagaagcaacagtctcaatatgtcctttttacctgtataactggaagctgttaggtagcgacaccaacagtgtcagatcacgtgtttcctgatcttgggatatacttgtttatggcgataccaataaaaagaaaatacccgctagatatatagattatattgccgtgatatattaactagcagcaccaattaatcggatgctctggtcgacaagtccgaggtcgcatttcccgttgcagaaatcgtgatcgggaacgagaatccgatctcgattctccgcgttctcactcccggaccgtggatcccgaatcgcagatcgccactgcaccatcatgattgatgtacgttattatatttccttttgacagttctcattatttcttggtctctacaatacgaaccgtatgataaaacgtgtcccgcttttcgcttcctaaagttgaaaccatactcctcctccaagtcactatgccgtcggaaaagcacaatgtcccaaagcgactccaggttggagtcgttgggattggtcgaatggggcgacgccacgcaatgaacatcctccatgaggtcccacgggcaacacttctttgtgcttgctcccctgcagagccggacctcgtgtgggcggatgagcatctcgtgccgcacggggttcatgtagttcccacgtttgaggagatgattgaaaccccgggcctggaggcgatcattattgcttcagctactcatctacacacctcgcaaacaacggcagcattggaaaaaggcttacatgtgctttgcgagaagccagtctgccaatctctggacgaggtcagtagcgaatttcgagaaacgacgcatacgtatggctaattttagagtagctcgtggccctagttgacaaggtcgaagccaatccccgggcaaagctcatggttgggtttgtacgccggttcgacaccaactatcagcaggccatggagcaaattagcgagaacaagatcggacgaccagtcgtgattcgatcgcagggctgcgaacctctagatgagagcgattactacaagcaatatcttcgagattcgggcggcatctttgtagacagcatcatccatgatatagatctctctctgttcttctttggggaggactctagaccaaagtcggtcactgctattggtgtagctgccgtccatcaagaaatccaggcacacggcgatgctgataatggcgtgggcatttgcgagttctgggacggcaagattgctttcttctataattcgaggaccacggcgcatggatacgacaatgcgacggaaatctttggtacacggggaaaactgtctataaacctgatccctcgacagaatgccctcgagctgtgcgacaaggatggtttcgtcaagacctttgcccaccccggctggtatgatcgatacgcttctgcttttgttggcgaggcaaagggatgggtagacgctttgctcgatggaaagcctcttccagtacctttgcgatcttcattgacatctctcaagatagctaccgcactccagctaagcttgaggacgggccagaaaatatttttcgacaagcagggtgttcagttggatcatcaaccatcggtaatttgatattcttgttttatatatatcaaatagatcaagtaaaataaaataatgtttagcctctgcaagggttggatataacataaaaaatacgaattgcattctgtaatcttgatgctggcattttcagactgtataatggtcatattctcgcgagaaatttagcattgtggtgttcagtgcaactcttataacagttctcaacaatactcgtgaactgagaattatagaccgaattaatgatgttttcatatcgacgggcgcttctttgagatgatagtttacttgaattttctatggcagacaggcatcatttacagcataccaactccgcggtaatctggagtgaattaaggcaacaccgccataaatgtattgttctattgacacttgactatgtactaactagccaactgaatacatgagaaacaacacagtgataaacgtaaccagaacacagtcgataaaatgttagagatgatacgttgcgaacgtacttctcgtcgagagcttattctttaccaaaccagggccccgacagagacccaggacacatggatgaacccatgttggacttgcgacgttggctcgacgtcaaatcaaggaggtccatcagttcgaaccattcttggcatcccttttgggaacatgcatgacagatggaagagcttcgctcgtggctttctcgttgtcagtgacaccgccagttccttcaatactttcgatgggtgcgctccggtcgaagatgctgtcgatttgctccaagctcaaccgcgcagtctccacgtaaaagaccttgcaaatgattgcaaaggcagcgttgagaacagcatagatgaggtagtatctccagttgagattcctgatgcctacaggcgtcactagaacaaccacatagttgttgatccaatttgtggccgttgcgacacctgcgccagcgatcctcatgcgttgtgtgtttacttcagccgggtacatccaggggacggcgatccaagtcaaggcaaaaacggtgctatatccaaagacaaaggcaaccgcaaccgcttcccatctgctgccacccagactaagcccgatgctgatgaagcagaagcagatcgactgtcccacggccccccagaccatgagcttcttccttcccaccccttcaatccacaaggcgccgaggacggtagagatggtcatgttcatggcgttgcaagaagacaagatgagggacaggttacgcccaacaccgagagaggcgaagacaacaggcaggtaatagaagagcgcgtttatgccactccattgctgcatgagctgggtgcctgcgccaagaatgatccggcgcgtggtctgaagcgagtcgcttttcaacaggctccggatattgatcttgcccagggacatctcatgttgtacgctcactcggatctcttcgtgtacggctcggttctcgtcctcggtctgagagttcccgcccagcctctgtatgacttcgagcgcctcctcattgcgttccttcatgatcagccagcgaggcgagtcggggagaaatgggacaaaggccatggccaggatcgcccaaaaacattggaaggcaagtggaaacctccaagagacgctgttggaagcgatgaatgtcatgccgtagttgatccactgagaagagacgttgccgaattggttgagcgcaagctggaggaccatgactcgcccacgccactttgcgggtgccgtttccgactgccaaacggggatggacgtagtattcatgccgttgccaatgccggcaacgaatctgccgatgatcatctgcgccgtatggtaggatgtcgtttgcaggattgcgccgagaatcagaacagtgcagccagccaggatggtcttgcggctaccaaagtggtttccacgccacattgtaagtagcgcaccagcgaagcaaccaagatcgtatatcgctgtgatttgtccttggagagttggatcagggttgctgaaggtcttgatgaaggactcattgtcgagaagagccccaaagacaccttgatcataaccgaacaaggcgaaacctgcccctgaggcaaaagtaatgtagaaggagagccatttcccctgagatgtcgatggccacatcattttatcagcagtagagtgttttcaaaagttgaagaaagttgctgataacaaaacaaagcagccctgcacgtcgaccaggccttatgtaggagtttggacaacaatagtcttcaaagagtaaggaatactgcccggaaggtggtatccgagtgcagcaagccaatctctggcctctcacgaccaatcttcagagaagtctggggaaaggtgtctggggtagatttgcgggacaatagcgtgggaataccgccacctacctgagccacgcattccctatccgatgtgatttattctactacaaaagtagaatagtgcagaacttcctggctcatcaagctgctaaattcgaggctataccttgtagacttagacattgtatgtctcaccacggcttccatattccggcagcaaaccatcaaccaatttccgcttcttgtgcagtcataggattagaaatagatgctataagtcataataccatgtcgttctatcgccccgttcagtactcactctgtcaaggtgtaggataatctctcgcccagcaaacatgtctcaactcctccttgaaaaggtcattatgtatgtggtttcaaaattcccactttccactttgtgccgttagctcatcatagtagaatcacaggagccagccaaggaattggtcgtgccattgcaattgaatgtgctcagaacggtgcactattagttatccaccacattggggatagtaaatcgcagcaggacgtggaagcccttttggctgagattagtgctatcggtaatgcacgagaatcagctcctagtgctgtacatatcggccttgacgtgactctccctgacgccgggaaacggtacgtgatttacacagtacctaattctgctcaattttagaaggaaaatactaaccaacgaacttgttaaggctggtcgatctagcagtttcgacgtttggaagagtcgatggcattgtccacaatgcaggcatcgcgcaatatattgactttggcgcggtcactaaacagcagctcgacaagcatctgtcagtaaactttggtggcccattcgccatcacccaagctgttacctcacagatgattgcacaggactccggaggttccgtggtttcgattgcctcggttacagccacgacagggtcaagccagctcgctcactacgccgcaaccaaggctgccgtcctgggaatgaccgtcaatggcgccgttgcccttggcaaacatggtatacggtttaatgcagtcagccccggaacaatcacgacttctatcaacgaggcagacctcgcaggcccaaagcgagcagccatggagggcagagtaccgctggggcgtctaggagtgccggtggacatcgcaaagccagttgtattcttcctcagtgacatggcacaatatgtgtcaggccagaacttgattgtagatggggcggccacagtcttttaccaatagccgtttgaagtacagagatacttgacttgcaaatacgagtcaagtcattttggtctgggatggctagtggcggcaaaatttgcacgcgtcgggatatggattccgagatggtggcccctgttcttggtacgacttttcctcaagctcaaagtatgtcaaagaggcagagtcaataataaacacgaattatttcaggggctagatctagtcagcaatctgatgcagccagaagcgagtacatccgaccccatggggaacagtaaaaatgagatccaatagccataatcagtatcaataactccgtgacatcgagatacccttgcataaagaaaagtagcctagcagcgtgcgccacggactcattactaatatgtttctctctgaagtggcaaactctgaagcaccgcggcacattgtatcctgatagtatgcttgcctgacgcgctcctaaccagagagggaaatcggattgcggggaagggagtaattattctttgcggcacatttctctccacactcccaagaaccccaaaaaccgtccctctcaccaacatcccttcatcattaagatggtcgatggtggcagtcatcatcattctgtgggccgtcgccacatcagcaaggcgtgtatgccatgccgcgagagcaagatcaaggtcagcaggcacctgcggttctgtctcaaggtgatccaagtgaactcacccatgaccctgtagtgcgatggaggacgtccagtttgtggcgtgtgcaaggccaagagtcggaaatgcaattatgatatcggcattgacaagcggaagtaggtcgccgccatgcaattgtgttaacctcgctgacttgggctgctaggatctcattacggagagctgtcgagctatattcacgtcgcgttacgcagctcgaatcgtgcctgcgtcgtgtgggcattgcggtgccagatcctcctcccgaggacagtcgcatgttgcgtgatctctcacaatcatggggagctgatgttattgagaagtcagatgccacagcccaaagtgtgaatggccaagaagcactccaagtcgtgggagactgttctatcgtctctgaaaccgctccgatgacggggaaccaagcacaagtaccctccgatattgagtcggaccagtttccgctcattttacctggtggcggttcggaagtccagctcggggattatatcccttcagcttcgaaccagtctcccagctttcctcatagctggaacatggacgcagatctcgtctggtacatgtcaacgctgccgtcattgtctatggatattgatgaatctttggcctctggctctctaccaacccttttccctgatgagagttccacagaaagactcagcaatcttacctctgacccttcagccgctgacaaagatggatacgacgatagtgacgaagaggatgcagcaggagtaacacaccaattttgcgaccgactagggactctactacccgcaccaagtggagaatggagattctacggagcgacatccaacttgcatctggttcacggtgatctcggttacaaaccatcagggaccaaccacacctcgaacacgcctcaaatgacctttgagcacgctggtgtcggtcaggtggtcgatgataagctcattagtcacttgatcaatctctactttacatggcaaaatccaagccttcgtgttgtcgaccgcgaagcttttgaagcagcccgcgagaagcggctaaccgagcaaatagaaaacggtttttattcagaatgtctcgtcaacgccatgtaggtaacccatgttctttacgcagtgggctcattgctcatgatttgcagatgtgccgtaggtgcggcctttgagagagtcaagcatccagagcttccgactccgttagccggattctttgcgaaacgtgcgaagagcctgctagactttgaactcgacaatcctcgacttagcactatccaggccttggcgattcttagtactcacgagggagcagagactcatgacgcccggggatggctctacagcggtcagttttcttggagacgaccccctttgtcaccatctgttgactgaacaacctgcttcatctagggatggctacgagacttgccttcgatttgggtctccatgtggatcccacaccatatgtctcaagtggaaagatggccagtgaggaggctcgagtacgcaatgtcacgttctggggaacattcgcaacagaccgtatgtggggattttatctaggtcggccattccataacacactagagaatgtgaccgtgcggcgtccatttgaagacacattgtgggaaccaaacgccctggagaccgcctggacaccttatggaacgccggcgaaagaccaagagacgtggccgaatgcacaagaggctgtttctggtcggtgggtcgcgttgtatgaaatcatgtccgagcttgggtacaagatgtaagtcaacagcttaccgggaggtagaaatatactgacaataaaaaggtactgcaagacgaacgtgagcaacgtggaactacaagctttggcagagaaaacgtttaatgagctcgtcgtttggaagtcttgcttaccctcagagctggtaatagacatgaatcatctggaaacaggtctctatcttccgcacactcttatactacagtatgttaagcctctcttaattatatcttggctggaactgactagcctcagcatgcaatttgctttttgcatgatgattctccatcgcccatttgtcgccaagcgctacatacagccatatcctcgagttggcaagggccctgagcatgcacggatgatgtgcattcaatctgctacagatattgcgaagctcatcggggaatacgagcgtcgctactcgctccgccgagccaacgtattgctcgttcacatggcctttactgctgcacttatattggtatatgccaccgtgtctgagatgaacagacatattcatgtgcaactgtcatcacatttagatgtttgctgtcatgcactttgcgagcttggggtttcctacgaaagcgcatccaggtcgctggacattctgctctccgtaaagaggatgtggcaagcccgcttagtagccggctcaatcggacagaaaagggctttaggaaggagaggtaaatttacggcgggaagcaaaaagcaatgtatgacagactaattgcatatttgaaactttagtcttaaactatgtgtgttctcatcttatcatctgtatatgaaaccaacacattattataccaaaaccacattgcacaagtcctactatgcttagttaacgtctcccagtataactccagatagaagatactgactagcttagatattattcttacaaagtgttttattaaaataacaaccggttttaaaagtgaatcaagattgattacgttagacgtccttgctcttagtatctcgatctaagacacatctggcgtagtgaaataagctcagccccttatatttacgtatcttagtgtcggggtgcggcacgttatttagagccgcgttctttcagctaatggcttaatagagcggacaaggttttctacttactcccgctcctttacccggattaaccttaggactcagcaacacaaaatgagtgattcaacacaaagctcgtcagagacacggcgtaatcggacatgcgaggtactggacccatcccctgtatagcgggcagacgaacggacgcagctaaatgatttcctgcaggggtgccgaaggaggaaaatcaagtgtgtgccagatttaggctccaagaatctcccgggcagatgttctaggtgcaataaaatggatctagaatgcatttacaatctcccagcaatcaagagaaaacggaagaggaacgagactcggatccgtgagcttgagcagaagcttgaggaggttcaacagtcaatttcggaccagcaaggcgccaaccgatggaccccactgccttcgggggtttctccaatgacagagcccatcgatggttctttactgacagccagccaaatcactgacgggcattcgggttgcgaatcattacctgggataactgaggggccctttgcagagggatatgttaaggatgatcctatatcgcgcggcatagttgatgaatccctagcggacaaactctgcattgtgttttgcacggaaatgctccctcattatcccctgatcttaacccctgcaccaatctcatacaagactcttcgcgatgatcgacctgcaattctccgcgcaatcatagcaacagcatcaagcatttatgcacctgacctttggaaatccttgttccaggatgctgaacgctacattatggagcaggcactgatgagaggccggaaaagtctggatcttattcaggcggcattacttcttgccacctggagtcatccgcccaagaactttgaagaccttaattttggccagttcgtcaacattgcggcgaccatgatacttgatttgcggtcatcgaatgatccacggtatctggtttcgcctgaatctgtggcagaatcaacacagggctcattggaagttgcaagaacattcctggcatgctacttgctctcttctaggtatagtggaatgttccctgatcttatagcgtttttctcatgtttttttcagcatagcaatgtccttacgccgacctaatactatgccatacaacacctgggttggagactgtcttgctgtcttaaattccactgcaaccacacatatcggagaccgtcgattggtagcatggattcatttgcagaagctggcagaagagactctggccatggctgggattgatggaaactcatcgggaaggtctacagattcgcgaactcatctgatcctcaagagcggtctggaaagagtaaaggcctggagacagacggtctccgacgaaattatgcacggtacattttctttcttcttactctttttattagattctaagcttatgccaacagacactcttaacattcactatcatgtgatactattgaacctttcggagcccggcctgcatggcaagcacaacgccaatggctttcgccccccttactctattaatacaagacctgctgccgatccattgatacaaaaccaaccacaatttatcgacgcacgaatgaaatgcttggaagtcggccgtaagatgatgcagatcttcaagcacatgtctgcggagaccatacgccagaagcctgtgattactttcacaaggatcatgtacgctgctgtcatcattgttaaactggccgtgtttgaagggccaaattctgagcactcatcggagatagactctgacatggaagtccttcatcaaatccacgaaaagctggcatcagccgctgaaggatcacggtatcttgtccctgcaacattttgtgcagtccttcgaagattgctcagtcgatgtgttcggagggatccgcaggcaactaatggacatgatgcgctcatcgaaccccttgctaatctggaactggaagactcgccggttgatcattcatcaacccattcgcttgtagacccagttatccgagatcctccttatctaccagaagaggggcatcaactctctgatattggaccggcctccctcggcatggagattcaagcctcttcaaacctatttgcattatttgatgaccatgtgccgagtacaccggatgatgtagctgctgcgatgttatggaataattttctcagcgaggattcgttctgatctaggccaaatcattatagtagaggatgttagatgaaaaacctaagacaatctttgctgtagtgatgcaattgtcatgtgttatagaagcctagcgggagactcgctcactaaggcttttgggatacctacatattgtcagtacctctatgacaagttttctaagacctgcttttagcgaaaagaagtttcttatggtgtgaacttaggggaatgcggtatattgacgtgaaaggctattgggaatatagaaactgtgaaacggcacccaggagataaatttagaccacattttgctatcgactgcgtctgacaagcagctactagtccacttatataggattacctacctagagtatcgaagtagttgtcatacaatctcagtaccaatgatcgctggtttggtagaactaatgaaaaccaccatgtttgggttggagagtgcgttgtaccctagacttttgagcacacagctccgccacccatccagtccttcacacctttggggggatacacgtaggcggcgtgctcagccaattcctttaggtgcctgacttgaccatgagtaggaaggacataagcattgtctggcaccccgtctttatcgacctgatggagccactctcgcatcagctggcgatcattttgggcatcaggcgtgcctggaaaccaaacgtcggcctcaaacacggcaacatcagagttccccgtgggacatttttcagtgatgaaggcgtaggaaaagtcgatggcgtgcgtagcctccttttcccaaataaaccaggcttggtacttgttgtcgctatgaacataaggatgggtctcactgaggatatgttagtaaggatttgagtgaagcgatgctgaaagacctcacttgaaaaggattagctctgcgttgggaatactggcccagtatttggcagcaacttcgggcacgattagtttggcgccgagcttgacatactggctggcgccgccgctgtggtctcgatggtgatgggttggctgccactgggtaagtctctgtgtatcatgatttggtgtgcttgtaattttggcttacccagagatatttgattggtttttggatattcttctctatccagagaatcacctccttcgtccactgaggtggagcatccccaacaatgacatgatcctcgaattcaataattaactgcttgacaccaagtgcgtcatcgtcaagcgtgagccaatgggtattagggagacccggaaccggttgatcgtgtttgatcccgtcgacagtagaattggtaagtccagaccaaagaccgttagagctgaactccgtgatgcggtcatgtgtgaagccctcaattttccttggcgcagttttaggaaagaagccctcaccctccggtaggccgctgaagaaatcatttgggaatccaggattgacagctatttcctctatgatgtaatcctcaatcacagcatcgagcttctgggtgctggagttgtacacggtctggacgatatgaggaaacttgatgccttcgacagttttgtagctagaaagatataagtcattggtggaaggtccatatatcatatgattctcctctgctcggacgatgtggggaagatgactggaactgtcgaagataatggtgatgtcaaagacagggtcgtaaactactgcagcatcagattagttcagagaaggaatggtaaacaaagtccataccagcgggcatgcttgccccgttaatttctacctcgacaaacgtgatattattgtgcattttgaccttggtaactcagtataccgatgccattagggaaagctgcctggcaaggcgatcacttacctggaggaggagcttaggggatagcatgtttccatgcaacacaaaatattcggcaagtgcagctatgatatatggtaagaggatgcaaaggtgttcgcatgtcaaatccgcagatatagtttcttaccatcggtgtatcctgatgcaaggtttgttggaagccacacttggttgtttccgcgaatgtagcatgcgaacccattctcgccaccatgaacaacaagcgaatgatcgaaatcatcgttgcttggagttgcccaggaccagtactctgcatcatggttagatttgtttgtagttgtcagagccaattctactacactagcaaaaacggagcgcgctcgcgctgattgctgtgcccaattgactatatagcctgtcactgacaccaacagtagtaattggtaggattagttaccggaggggtggaatttgcggtcaattcgcagggtgagctcgccagagtcaaaactaaatgatatattctgggagccagagacagcgaccggggtgtcagcatggtacaaattgtaactttgcatgaggctccgggagcggtaaacactagagcgcgttagctgcgtggtaaactcggatcgtaggtggtgacaccgacgtgggagaggagtaagtgactccaccaagtgctgaaatgacattttctccccccagtgcaaccaaagcttgatccagaacattttgagcagaattgttccatctgggagacagcgcctttgaagaggcaagctgtatgagagctagacagagagcaaccgtagtgcgagacatgtcaaaagataaataagactggatatgaggattatggtatgggagttgttttggtttttgatgggtttcattgtcaatttgggaggatatccaggacttcttatattcgttctctgtctgcacataagttttttgaattacaaacactacttactcagaagtgattactcgggtctcttgcctgggcttacgcgcggcagatacaaagcaccttcacctgcaagtcatatttaactccgcgtcagaatttaagccgtaattacgtttatgcatagaaacttacctacccttaaatggaataacgcatgataatcttaatgtagttcatttcgaaatgaaccgcacggctgtacatattgacagatagctggccactccagataaagtaaaactacgctgcatgagacgattcacttcagagcggttacaagccttagtccatcaaactgttcatacgatccgttgtgattgaaactaatgaagcggctactcaagtaaaaaacgttagcgtttcctctcgtttcttccttctaccttctctgatggatgcttgtacgttttcaagatggcttagacctacgtagtggccttggtcaagggttaatttaccgagcgggtcacggaagtgactaaacttccgcgatcctcgatcgctaaaatcgctaaggacttcatcaagcacccgtgctgaccattatgcttaccgctaagccatggtttttagtcaagtccgcggcagttgagtgcctgcctttgccgcaccctcgcgtttgcgcaggccgtagtctaactagagactgcggacacctgtataagaatctaatccaagaacaaattcagcttttgattgccacaatccattttgtacaccagtaaagtgtactattatcgaggcgactttcatgtcaacagtttggagccttgaagattttgaataggacatctcatcgaaatgcgtgtactcatcgttggaggcggtattggtggacttacacttgcacaaggcctgctcaaagctggcatagatgtcaaagttgttgagcggcaggtaagactgcgatcctcatttggtcgagccatgccgagatttgactcatcatactgactatcataagatggagaaatcagaaaatcttgcaggatatggtattcacatagacaaaaatgggaggcatgccttgcggtcgtgtttgtcattgtcaaactggacgcgcctccaagcaagattttcatccgctgggacgcagctgttcttccgtgacacccagcttagagtcttggcagagaaagatgatgctgttctgagtgaaaaaccatcactagaagttgaacgaagcgctgtgggcaggatagagcttcgtgatgctctgttggaaggtttgtccaatccttcatccaagaccatccaatggggtcggacattcacagaatacactcaactcgaagatgggcaagtacgggcgtacttctcggacggctcacatgaggattgtgaccttcttgtcggcgctgacggacccaattcaaaagtccgccaacagtttatgccgaacttgaatcgcctggatcttgggattcaacctatcgctggtcgctacattctggacgacgagaagatgctgaaattaccgacggagcttaccaacggctcactgaacaatattgtgccatatgggaaaggttggatgttcatttcctcctggggatcaaaacagacaaactcaaaagatcaacactatgtgttgtgggcttatgtcgtgccagtggatcgtgtcgcacggacatgtgaagaaactgacctcaaagacagtgttcttcgtaacatcagtcaatgggcgccagagttgaacgaattggtcaatgggacggatccatcaacgatcaaacgcctaccaattcgtacgatgcctaaccttgcttcatgggagccaggcaacatcacactaatcggtgatgccatccataacatgacccctatggctggaataggagcaaacaccgctctccgcgatgccgaggttctgacgcgatgcctgattgacgtcgcggctggaagactcggtctaactgatggtgttggggtttatgaatctacaatgaggagatatgcgaatgaagcgctgaagttgtcgactcgcaacgcaatcaatgcctgtgagggaggtatggcgcaacgtttcttattccgcaattttcttcgagctgctcattctttccccgttatcatgcgagctactctcggacgtcaaattgaatagtttagggttagtcaaagacccaatgcatgagattacttgtagttaaaagattcttatagtttattatagctcttatcctaatatcctattataaaccatgaaatcaaaacaatatatcgagctttagtgcttgagatataattttatatcttattatagtcattaagaggctttaatatattatattgttaaaatatccagaaacctatcagatgaggaagggttatacttaaagtaatactatagaggaaataaagtcgctcgcatctgatctgaggcagttctaattggtttggtgagggtggcattgcctcgagtattagatacttatatttggattttctggttaccttcatatttttaccaaatcggtggcagtagggcctgaaagggatatttattttgtatccgagttcttcatccgatatgagaataagctgctcatcaatcctcgatttcacgtgtcctattccacctccctagtcgaagttctaagtacacagctttacaccaatcttctcgattacactaagctcaaagcttttcactctttccccattcaggccacaagatcttcccaacaacccagtgccccctccacccgagctcttgtactaaagtgcgagcagctgtactattctctaatcttccccctttacttgcgacccttgctgccgccgtggccacttccatgactgtggccgctgcccttgtcatcgcttctcctgatcttgcggcccttactgccgccgtgaccgcttccatgactgtggccgctgcccttgtcgcccctcatggttaaatcgaaatccctctcgtcgaggctgtcgataccagccagcaaactatcccgctcttcaatcccaataatctctctgagagcgacattgttcggctcgtggtaagaagcagctgcaagagcagctgcagaagtgagaagaaaggtgtagaaatgcatattatgagggcgaggtgactgagctaaagtgtgtgaataggctcttgccagtgggtctttgtgttcttcaagagatgaaaagatgatgaagattgaaagatgtgattgttgttgtcgaatgcttcttcaatccagaggaacttcattgctctttatactcagaataatacaatgaaggagggctattatcagaataatataatgaaggagggctgttatagaccatcagtgccgttgcccgttgatgtaaaaatagaagtcaagtaaatgaggttgcgtgacatggcgatcgctggattagaccagtgtctgcctctctctatctggctttgagttctttgagttcccccacgcaggaaaggtgagctgctaatctccgaggtcctcctctttcgcctatcaccgccgaccgtccaggactcaatttcggtaatttatcagactgtagcatcgccaaggcaaggtatcccacgggcacgtaaagacacgcctgagatggcgttagtagctgtgagttcggcagggtagacgtatcctacgtcaggaagataaccgaattgcgcgacgtgctaaccctaacccgatataatgtgcaatttttgctttattatcttcggtgacaattggtgacaaaggaccctctttttcacattgtcatgcgagccactttcagacgtgagatctaatgacgacaaatcgaatagtagatgatagtgagaatattgttcgtttgtgtttctaatcatggatcttgactcaacgccgctgcgactcttccgcgactctcgtttgctgtccaatcagaagcctaactgcactggttgttgtactacacagctaccccgagctaagaggaaggcctagcatcacaactgacaggctgggagcagaatggataaataataaccaacactaaacttagtggagatgtgcgaagacaatgcataactcgttattacaagttttcaatgtctagggtaagccattgtccgggactaatccaggggccaacgaaccttgcatgaaacactatcatggaagttaggccataacagtcgtcaatcaggacaccggacacagccagagcatgagacaggcgtgtgtttatccgaatcaagagcaagcatataggtctacccactaccaaattattagctaggatagtagaggacaaggacagctttataacaactaggagttgaataactatacatgtagctacgtttcctctttaatggactttaaatatcttcaagggacaaagattccttgttacttttgatattcgcactgcgttagcattgttccggttatcatacccatgcttggttgatgatcgcccatacttaagatatgtctcagttctcccagcgtcaccaagttaatcgcgccttattatccgaaaactgatcaatacgcgggagtagttttgatcttacaatgatttagggtgtgctaacaaaaatgccgcctcgaaagttgccaatccctagctaggaagtttgaacaaaccgaatgcaaatatgaagatgaatctaggacctacgttccagccactacgacgcaaaccatcaagtttcgcgagacaagttattaaattacctcaaacgctacaaatatcgttgaaaagctggtttgtcttgatcttttcgtcaaaagcttacatgtatactgatattttcacttcgcgggttcaatttcacaattctcatcactctcaaatctgaatgacctcgctgagatgtcaaattatatttgtaggtaggtgaacaagcatgttgtacttgataatcaatctggtcgattctgtttggtactcaaagcacgaagagtaattccctctccctgggttgcttcggtctgctgctacggtggcataggcagtgacatgtcatgatcataatcaaaagcgtcatcgaatcacattcatgacacgtagcatgtgccaaaatgtcatgcgacctgaatcacctccaccactctattggatagtataattccctgctgtacggttagtattagaagttttcgctattttattcactctctgtggtcaggatgattgaccctagacgagtcaatcgggctcacctgtctgatatgcaaattttgttcgccttctgaatatatcaaatgtaccccaaagtcaaatgtctgactctttgtttcttgtcaatcaatgcgtaagttattaggtagcatttgatctgcactcgtttattcgtgcattatgaacaatcaaccctgcaatgcagatcccctcatgtttacagcaaatcacaccacccttacagcgctctaagtgtctacattgtcagagaatgacgactttcttgcgtcgtcaactagtcatagtgaagtaccactattcatactattactccgcaagcaatattattcgctgcctaaggtgacagacaagcagcagtatgcatacttgaacggctagttagttgacaaacgttatgtcgcatctctcaataattgagtcacaaggtaagtatttttgattatgttgggtaaccagaagtggtttgcgctggccacaattacatcatcagatcgagatatcccaagctccagcgtagcattgaagtgcggaggagaacctgacgcttcttggtagaacccggtagacaaccattacatgcttcgtccattcggcatttgagctaccaccgagcatccatgcagcgtttcatcagctcgaacatgtaggtcttgctagatataaagacttcgttggcccatcgcagaatacggagagcagcccggaccacagttctcctactgcgtaatcatctgatcgccatggacttcatctatccccgcaacgacgccctcaaggtcaaccctccgggaggccaatcacacctcactgacggaggctccagttggctcttcgccgtcacggctctctttaccgccggatttgtgggttatccaataaacatttccgacccttgtctaccaaagaactcagctaatgctcgatccaaactttctagcttgtctatttcgcactgagcttcaggccgttccacggggagaaggtcttccattatctcttcacagtcgccctgcttgttggtgcgatttcctactttgctatgggatcgggactcgcctactcggttatccccacggagcgctatattagagatgccgccacgtaccaggtcttcttcgctaaatatatcttctgggttgtctcctttccggtaattattatagccattggtctcgtcagcggcgtgagctgggccaccatcttctttaatatattcctctcctggatctggtacgttaaatcttttagtatgtctatttcagtttgctaataatcatcaatagggtcgtctcatatctttgctcggcctacactgctacacggtacaaatggggattctatagctttggcaccgttgcctatgtgcttctcgcagtccaaaccatgtggtcgagccgccccccggcgtaccgcctagggataggccgtgatcatactggtctctcggggtttgttaacttgctttggttcttgtatccaattgcgttcgctatctcggatggcggcaacgtgattggcgtcacacagagcctcatattttttggcattctcgatctgctcctcgtaggcggcaccgccttcatctttctcttcctcgcccgcaggtgggattttggtcggatgaacctgcacttcacccaatacggccgcgttggctcccacacggacgccgtgtatcctgagaaggccggcgtgcgtacaactacgcaagcaggcacaactgcaccagcgggcaccaccacggccacaccggctactgcggcagtgtaaaccctctgcctagcaagctgaaaagtcggtcggggatgaatgactaattgtaggaggataaaccatgtttggattggtattacatatcaagtgcgaggttgagcgtgagcttgtaattagttccgttgcaggtcaagataggtatggacaagacggggttgatagaatggaattctatgaggcgcgtggaatagtagttgataaaggcccattcaagtttttgctattgccaccggatgtgatgcccgatctctataataatagtcttttgtttctccttctactagacataaagaatattgcctctgatgaacactggctcttgagattcacccgaacctgggatggagccagttaaatcccatattcttacatatgttttctaggaagcacagtttagtccaggaaaccgtttcacaatggaaaaatgactaaaagataataagcactaacatatatatattacatcatacccctctattgatgaaaaagactatgtgaatttcatttaaaccaatcactcgcaagaatgtcaattgctgaggccctctgtgatggctcaaacttgagcatccttgaaaccaacttgccaacctcgccgatatcatccgtggtaaattccggttgtcgatggtcatcaaaataaacttctttcaaccattgacaaagtgaatagcactcttgcgaataggtctcttcttctatgggtaatctctcctccattgttttccatttctcctgccatcgtagtggtaggtcatcagtagcgaatgccatcatttgttgaacaagatccgcaggaatcattatgctgtcaaatggaggctggcctgtgaccagctcgaaaagctaatattgattgccgtgttagagtatcgcagtcaggctcagagtcatcattgattgcggtcgaaagtagagaatacataccagacatccggcactccacaagtccacccgcccatccagagcatctccaaaaacaacctctggggcgcgtacaggcagcggtgtgtgcaatattactggaggctcattctttgaaaacgcctcgccaaaatcgatgattttgatcaatggggaggaggagagaattcgattgttcgcgaatgtagccggccgaatgatgtgtaatgggaggttatctggtaggggttgtccatctcgtgactttacggcaccgatttcaggcttgccgagtttctcaaggaaggttttctcatccgatgaattaagtccgggtatctcgatggccaaatttcgcgtatgaatatctgcagtgggaacgtaagcaggtggaaatgatgcataacaagcgcgtagcatacctccatgagcgataccgtgatgagcaaggcagtgcaagccttgaaaagcttgttgtgcaaaagattttgcaagacgagcgggaagtcggtcacctttgcagaaggattccacaatatccgctacacttgggccgagaagttgcaacacaagacaatcatgggttccattagggccaagcaaagtaaaataatcaagcatctgatttagattggaccgcccaggattatcgttaggaagggcagatattgcccgtaatattttcacctccctttcgtttcttgattcggatgtcgaaattttgacagcgacgtattgattctctctgacaagtgttaacatgtttgcagctttatccatcatttccatagaaaaacttactgttgatcctttgcagcccatgctgtcgaataaccaccccagcccagcttatggaggatcctgtaccgtccatggttcaggacatcgccgagtggatggaagcctcctggccgataccggtacagcggctctgcatcgacaccgcaatagtacgatagtggcgcgcatgactgatgagtaggaattgcgctgttggaataagatcggtgaaacaatttgactatggttgccttgagaatcggggctgggtaagtatgaggtgacatccttgtcgtgttgatgaagtgttgattctggccaagtcagtgtagcttccagtcaagtcaaagcatcacttgggacactgccacctgcgccacaacatctacgcccctctcggccatatctcaacaggtacccaacacccaacaccagcgtttcctctgcctgtataaaggacaggttcaagacatgggtcgccgccaagttggagaggctccaaggcaaaaagccaaccatgcctcgtcttctcgaccagcgaaaatacgcattgacaataacatcttcaacagagtattttgttgctaaagagtccttattcttcaagaaactgccgtacggcatccgacacagaattcaggttctgcttttggcaaccgtctaatacacatgggacctagctctcgcccagccccacgcaatgctatccaagccaaccacaatgccaaccgcacatggtccctccaagacagctgtgggcgcctgtgagccatgtggcccctgtcgccctttggtaccggtaaacccaagcgctggcagtagagctgctgcttatgtcatcacattccgccggactggaggggtgatttccacgacagggcgaggcatgtcccgtagccgggagacgaccgatgctgcacagggcttggggcctctcctgactagtggttgggccaagtaccagataagtgctatattggggtcatgggaggggtactggatcgcccttggtgataataacgataagaagtttaattatatgtttgagtctgacgcatattcaatccttgggggatcaatgatataagggaacatttctagcggtttgagaagcaagttctttttttcccttgtcttttttagcgaatagtgagacccctattgcactcgaagtattattttcaaacaaataacaatcaccttcaagatgatccatgtcacccggtctcggtataacaagactcgaggtgattcctaaacctatgatacctccgcctgggccgctaggaaattgtggtaactcccagtcgctcgaggctcctgggcagggttccgcgccgtgtctacatgatcctcggcggcgccgccctcctggtgcgtctcgtctggaacaccccagcctccgccgctcggcgtgtgcacgacgcatctgtccccggcacctatctcgaccagccgggagctgaatccacttgtacgctccgtcctcggtcttctgcgcccaaaagttgcggcccgcggcacctggctggccccccctcatgccgtgaggacgcctcacccggcgctctgagatgatggagaatgttaggggcacgcggcactcccagtcccgcacgatgccgtctccgccgttccaccgccctctaccgccgctgcctcggcgtatggagaactcgcggatgataatcgggagcctcctttcgagcagttcgacgtcggtagtacgcgtgctctggagagttcatgtgtcagctcaagtgtttgtctcttttggggggagttgtcaaatagttaccgtcatgtggatttgcacgccggaagctccgtgccaccccgggccggcaccctcgccgccacagatcgtctcgccgtacttgtacccgtacccgaggataggtgtgccgtcgggctcgtagcccgcctggtcgaagaaggcgaagcagttcatgcacccctgggagcccgacgcggcctcgaacgcctgcagcagcaggtcggcgagtcgctgggaggtgtgcgtgttgccgcatgccactgccgcccccggttccgggttcaggaaggtgccctcagggatgacgtcgtcgacggcgctcaaacagccctggttaagagggatgtcgctgccgatcagcaggcgcagcatgtagatgatggccgagtacgtgatggcggggggtgcgttcatgttgccgtgcatctgcggcgaggtgcccgtgaagtcgaagacggcgcccccgtcgccgtcaatggtgatctccaccatcatgaccgccccgttgtccatgccgtcggtggcttgcagcggcttcgcgccgcgccgtgcccgcgtctccttcaggaacgttctcacggccagctcggcattcttctgtatcttgtccatgtagaagtgcacagtgggtgtgccgtactcgcccataagtgccacgatcagttgactgccttttgtattggcggcgatttgggctttcagatccgataggttctcggacaacttgcgggagggtgtcaccctgggatattgtccaggatcagtgagtaatttgacgatgccctgctcgtcaaacttgccgtctcgcactaggaagaaggactcgatcatggcaccctcttgccacaggtgaactgagttaggtggcattgacgtgccgtcgaggccgccaatgtccgtgtgatggcctctggaggccgtgtagaagcagaaggtcttgccatccatctcgaacacggggctgatgacggtaatatccggtaaatgcgtcccacccgccgctggatggttgctcacaaggacatctccgggcctcaggttgcccttgtgcaattggtgctggtatttgacggcgtagctcatactgccgagatgtacgggaacatctagaaaccaaggactcatctatcagctatgtacaggtgcacccggaggggggacagcagacttacggggcgcgttagcaacgagatcaccttcaggaccgaagatagcacaagaaaagtctaaccgctccttgatgttaagagagatgctcgtcttctggagcgtcaagcccatctgttccgctatgctcatgaatcgatgcgagaagacgctcagcttgactgggtcaacgacgtcaatgtcatcaccgtcgggattcctggccgtgacttctggcatctcaatcacaatgtgagaagacagaacctttgcaatggatcccggtatcaagacaatggtctgcgtgctgtccacgatggcgcatggaccagggatgacagttccgggcttgatatccttcaggctaataatttgggcgtcgactgggtcccgggaaaagtatacacgactctacatacaggcttttagctctctgcgtcttcttctggtaccatcattgtcccgacttaccatttccgtctgagcgggggcttcactgtcggaggagacctgggccaactgcttgagaagctcagtggcgtctgcattgacggtctcgctcatgccgattgctcggatgcggatgtcgtcgaccagcactctgtggtccgaggggaaggcaaatgagagctccctcaggtgtgtctcctcgagcgtggtccgccaatcaacatctcgcacttgctgaatcataaaattggtgttggtgccgtcgtatcggaggttgaggtacgactcgaacgccgttgacttctccgggatgccctgtgccgcgagcccctctcgcgccttttgcttcagggcctcgatccttgcctgcagcttcgggagcgactcagcgctgagcacttcactgctcggctcctgggctttctggaccacctcagccagagccatgccgtaggcggacagaatgcttgagtacttgtggatgatgatgcgcttgatgccgagcttggaggcgatttcgcaggcatgttggcctcccgcccctccaaagacggccaagtgatggtggcccgtgtcgaagccgcgagcctcagtgatggcgcggatgggccggcacatagcctcgtttgccacgtcgaggaagcctagagcaatctcataagccgtcatggacctaccgctctcggcattgatcacggcggccagctccttgaacttcttggccacaatctcggtatccaggggcaggttctcgtctggaccaagatggatgggaagaatgacggcaggatacgtcccagaaagatattcgcgtccgtcacggtcagaggtccgccctttcggtacgctgccggcccagggtgagcacccgcgctctatgctcgtcttagcatcttgcgactctgccatgctagtcctcaggcataaaacttacctctggtccgactttgaagaggcggtttgtccaaaagagcatactgccgccgccaacagcgaccgtgttgatgtccagttgcggactctggatagacactcctaccgtcttagtttcaaagacatgctcaaacattccaccatagcggctaacatccgtcgaggttccacccatgtcgaagccgatcagcggagtgctgccgtcgtacgaagtcctcgcatatccaactacgccacctgcgaacatgttaattaggtatccagccgtccccattcccgcgggattaagaaggcaccaagagacttaccagccgggccactcaggatgccgccgagaccggtaaacttgtcgtagctggtaaggccgccgtcgctctgcatgaactcgcagatgacgccgtcgaggttgctgctctcgaatcgcttgaggaactcgccgatgtattccttgattttaggtgtcagataggcgtcggcggtggaggagctacctcggggtatcattttgatcatgcctcgcccaactactgacgatactgatacatggtggaaccccatctccttggcgatgctggcgatgcgaagctcgtggtcggggtagaggtatgaatgcttgagacaaatggctagtgtatcggtcccattccctcggatggtagacagcttctcgcggacctcggattcgtcaaggggtttcacaatccgtaaaaggtcgccagtgacggcgcgcaccagcttgccacatccgtcgtcgaggccgaatcgagaatcatgctcgaaaccctcgaatacgacacgctcggatatctcgcagaccttgatagcctggctgcggtggttgccaaaagctgtccggctggtgaataatggagtctgcgctgatgggccacgcgggagcccggttctggggcgcgaacaacctccatactgtagcagccaccatggactcgatgacatcacgacaccctgctgcttttgggtacctctctgccaccgccgcgaggctggaggcacagacctggccgatgttgacaatcttctcgggggcaagcgagcttctcagctcgtccgagttccagaccgagtaggtgagcagcaagccggccacgaagaggtgatgtgcccaaacccaaatcatgtccagatggccctctctcagcagggactgggtgcactctatcagcttagtggacgcctcgaagcaaatcctgagggatataggggatggcttggagacccgaggggtcggtctgtggagcagcagcagcgcgtggctgtaagttgcctcccaccagcttgaagacgcatagatgctcgctgggtgcgcttcctgcgtcgaggggatatcagcgtgccactgctcgagcctgggcttgatccacgcatgatagtcgggctgcggaaaggccatggaagccgtctgctgctggcggtagagaacgtgcttagtctcggcctcgagcctggcgaggcgtacaatgtggttcgccacacgctgggcatgcctctcctcaagcgacggatgcgcgggaggcgggcctgggtagccagcatccaggctctgctcctcaatgccgaggggcctgccgactgtgacgacgagcagcctatcaaagtagtaggctgcccagaaaagccggcggcgctcattgagctgggcttgcgttatcctcagcgcaaggttcgtttcccaatggaaacccagctcaatgcaggctcgtattgcaagacctgatagggtccagagattgcctttggagggcgatagtgaaacgtactgtgccagcagcaatatatccgtgaccgtctttgtgtcgttgccagcggtaccgatggtcgagtcgagacactcaacggctgagtggaagaaggactcgcttcgatcagaggccccttttccgacttggcccttgagcccgcagcaactgatggcaaatatcatcaaggttacaaagacatctcttcctttgcgttgggccaccgtcgcagcttcgttgtcatgggctagataggcattgtgtacgcaggtgaggatgtctgtccgctccatcagaggcaagtgtggcgttcgacattggaagtaaacgtcgatgagataggtggcggattcttttgatggcagcggcggtgacattctgggaagaagcaggttcatgcttggttcttgcgaggaacgtattgatggggacgtaggcatgttgcactggagtgatcccaatatcgccttggccaaggtcactccgctagaggttccgacgaatcttggctcttcagaaggatccaaaacggccagcgcaagggacgtgtagagctcagaaccagtctcatggtcggattgcggagtaaccgacgatgcttgctccgaggaggcggcctcattgttcggcgccgcactatgtctcgagccaagaagctgcacctcggctttcaggcgctcgatctgggcctccaagctctcgacgtagtcgcgggggatttcgcgctgcttgcccaagtcatagcttagacactcagtccccgccgcctcacagttggagcattgcgggtatttgaggtcgcactggagctcgagtgtcagcgacagtatgagtgtcccggcagcacaactattgtttgtgtttcgcctacgcaccttttgctttcttttcctacatctctgacaagcagaggcgctcctgttgagacgcgaggcttgtcgggctgagttcaaaggcatcactcgtcgactcccacacatgatacatcatgtgctgcattagaaccagtcatggggaatcttatctgcaggatcaaaggtccatcatctcggcttagctgtcacgtgccaacgacctctgccaacaaggaacaagttattaaacccggctgccagctaccctgggctatctgggatatttgcaggtcaaagaccaatctttactggctatctctctctttcttcttcaattagcaaaagtctgttcgtcacaactttatttctgtcctttaacctagggtattaatatacctactactactactgcctactactaactattactataacttaggtcataacaatcccgagaaactcgttgcccagaatgcaaaatcaccggcgtgaaatttaaaacttcgcgaaaattctcaagacactgctacaggataatatcctccccgccactaatcatggaaagataccaagattgatagggtggcttcttttcttcccaggcgatttgcaaggcgaatgcatagctacatttgtagaagcgagttccttcggcttaaaatcggtatagctgtgcgtaatatttatcgaggagatgttttatcgctgtattattttggaaatcctcaaaagcacgagaggtggccaggcaagccgatgtcgttcttcctaaaccaacaacttacatgatggcactgtgctagttggtaaaggtggacgagtcttgagacaaaaccgagaattgtcggacttggctcaagacgacagtctcagcagtgtctgggtttggaacattacttacattctaccacccttcaatctttgcggtgccgctaggtcgattgcgcactttagcatacagctacgggagggcttcagatggcgaatttccatgatttctaaaatccagtggcttaaagatgactataacccaaagcccaagtatactttcctatatgtcatcaagtcagcagagccgcgaaactcgatgtctgggtcgagagcggaatatgagacagtggcgtggcataagacatcctatgatgcctacatgccctaggctggattcgcattggaatgacgagcaaatgtctccctataaggacagccttgccctccgcaggctacagattcaagaccaacccaacccttcgatccactaattcgaagcaaaatgagagcaactctcctccattcttttgcagtttttgcaatctctttgccgtcatttgtttcggccgctgagcctcgcgcggtagatgctaaacaagtgatccttggtgactttgatgcaatctacaatctcacacaacaggccatcgacttcgagaagtatggctacgatcgatttcgcgccaacggggtgagttgcttaggatcaggtactcgcataataattaaccacctgtttaggactgcgtcaaaacgctcatcaatttgggaaagaaggtggtgcagatcaacaagaccaaacatccggtcacgcccctcaatgacaatgaccagaaagaagtctgcgatgcctttagtggccgggtatgctaggatgcacagcttcgcattatctacctgaaatgctaacgcgtctcactatgacagcgatacaccattcaccagggcaggctgatgaacgcactccaagatgggatattccagggaacaaaggctagctttgccggctactatggtgctctggttcgaagatttatcccaatattctcggagtttgaggattgggtcatcaagactattcccaactgcaaggtcagagctttgactgatagagacgtccttcttgtttttcggcaggacgccgcgaccactattgaactgagtcgaggctacaacaaggcgcagggagaccagattcccgatttcgtttaaggtagagaactttagaaaagaggtgttttgcctcccgacaagtattagctcaacactgatacctactgaaatttagacacccgatagaactgaagtaagggtctgatgttatatcaactcgaagaatgccatcatattcgccccagtatgtagcgtgctaagctctagcctgagaaggtcgacctggacgcagttgggcaaccacaggaccatcagttggaccttgcacagtcacagagtttatcaatgttgttatcattgaccacttaaaattaagacctatcaaattgaactagccatagcattggcaatgaagctatattccgtaagcatttaaagggtttattatggtggttgtattagcattaacatctctacagtatctctgggtttttatcactgtaagagaaatattactatatcagataatcgctataggccaggtgtaatatattacgtgtttatggtaaacatgtgtcacattacgtaggagaattacccgctgacaagaacaacaacacccaccaaaaccatctgtaatttgccagacccaactaccatggccaagctgtctggtgccatggacgacatcgccaaagtggctcgtgccggggtctacagcacattctggctcggccgatttgctaagcgatactataacaacgccgtgaatggcacatgtcttctttgcaacaatctcaagccggatggccatgagaaaaccactatctggacacctgagggagacaataaaccaactactagtttacctggaggtggcattaccaggtcgccagcatccggcggggatatccttgccctgaccctaaaggatctgtctactacaaaattgctccagtgtcgggatattgaccccaagactggtgctcccgcgagggactgtccatactgccggctcctctgcgagatatttgatcacttcttcatcgacgagtggatgagctggatcacagaaacccggaatgggatgccgattagcttcggcttaatgattcgacaaggtgctcctcttgttgtaacaactatcggattcgtccatgacaagtatttgaagaatgcccgcgcagatgtcgagttatatgttgactacgttccacctccgcaggtcatgccagcccttccgacaattggcccggccggtatcagacaaacagacactctttctctggcctgtacgtcattcatcaaagacagcattgagcaatgtgatcgggagcatccactttgtcgcaacgaagctcggggcttcaaacctacacgattgctccatctcgacgacaaagacactcatctacgtctctgtgaaaccgccggatggaagcaacctgagcgctatgcggcctttagtcactgctggggtggaagtgatctggtaaagctgacacctgctaccttggaagggttcaaggagggtatggacgtttctgtgttgccaaacacattcaaagatgctttgtctgtggcacaagagttgcagattccctacctttggatcgactctctctgcatcatccaaggagacgaagcggactgggagatagaggcagctcgcatgggacaggtctatagcagcgcattcattgtcattaccgccgcctcttccccaaacccagagacagctattctgggacccagagaagcggagtggctccccaaaacttttgacttgccgctcactcatgatgtcaatgtccccatcgttgcacgaaaacgacacatcctagcggcccccatggagcaaggacaatgcgagccaccgtttgccaatacggggacagacctcaaacgcattgggcctctctacaatcgcggatggtgcttccaggaagcttatctcgcataccgcaatcttcaattcacccccggcgcgattgtatttgaatgcaagactcaccgcaggagcgaggaccaactcccgccttatccttccaccatcccaagtgctcgagagtctgtggaccctaccgagcagtggcacagagttgtaaagtcttttacctcgcgccaattgacctttggtagtgacaagctgcccgccatagggggagcagccaggaccatgccccaggcgcaaacgacgcagtacgtggcaggcttgtggcattccacacttctacttgatctgatgtggcatgtgatgccatacatggtattggctggccaggatcgtgaggcgctttcctacgacgatgacaacggaggtccgcccacgtggtcctgggcctcgatgaattggggtgtggtttggtcacagttccccagaacgcagttaatagctgagctattggacgttcaggtcgccggcagtcatctggacccatatggcaaggtgtcaggcggtctactcacactgcatggccggctgaaacggtgcgagttgaggtcaaacggcgccctcacacacgatgccttctacacacaggctgacgggacaaagagcgaactacagcattaccgcaccgatgggccattatcgttaaaccatgaagctggtccgtacggcgcccgagtgagaaggggtcgccagggaccatactcgagcaacttggagactacggcggttgttttcttcataactagcaacacgctcttggtaaatggtatgtggaagcaatatcaaggtctagtactgggcacctcgccacgctcacctggttgcttggagcgtgtcggcttgatttggaggctgccggcgcattggtacgatactgctgaggagggtacagttcaaatagtttaagatggggatttgagagtgtgaatttataatgatgataaactaggagggaaaatagaaaaggtcctatggaggctgcgatcctgtgtagctggacattgcacctcgtcgttgaacctctctatcatacactaacggtgagctccggatccgcatctattgccagcatttatctcaatcgctttgtacacatttgacgagaagttccgatcgacttcaggtggtctagatgtgatgtgccatgtagatggatatacttgtgggatggttgctctaaatatagtgcgaagtaatcatgaaccagtggatttaaagccggtttagatatataacacggatgatgacgatgttgcgacgcgagaatgaggccgggattgtatagagggcatcgtggataggacgaccgtccatccgagtagcaactattggactgtaacatcgctgaagcaatacaatccacgggcacgtagaaccacgcctgagatgactttagcaaccggatggcaagctcggtaggatacagttatcttacaggaaaggcgagttacagcggtctgaggtcggcaactcaagcgacacattaaccctggcctgaggtctagacagcggttgggtctctataatgtgcaatttttgctttattaccttcggtgatgattgttgtcgagggaccgctttcttcatcaacgctcgaggatattttatcgctatgagcatctgcaacatcaaattctttaactgcaagccaggttggatagacggaaatgcctgcaatttatagtcagccctttgttttcccaagaagcaaaggtaaaccaaaattcgagatggcgcacccagaagaatcgtattggcggctagaggaactcgtccgcctttccattcctgtgagttgagcccatagctcacagcttgcgcaaagctctcctgacctcgcagaataccagaaaatcgacttagctctgagatgttatccgtcttcagtgctagaaagtaatagagccaattctgaagtgcttgacgagcaaagtcccaaaggaggagcacaaagaaaccttcgacgaacccggcatcctcccaatcccaggcaggtcgcgtcctcgtgtatttctcctgaatgacccatccatacacccaggcgacgacgtggcacactacaacgtaataaaatgcatatgtgacacgcttcctgacagtcactcgcttgtagtcgagccatgtgctgatcagttgtgaggagaggagagtgccaaagttgctcacaaagccgatcagagcgcgggcccgaacaccaaaatagtaggtctgaaagtttccagaatactgattaaagtaggctgcccagaatattggcaacagcagcaaaatgtctctcctgttgctcgcgctccagagcgctttgaattcggccttgaagctgctctctgctttgattatgatcttggacccgtctgctcgttggaccttttcaggcggcgagaggaggagggctaccggagcagcaatacactggagggcgacgaaaacaaggtaagtggtggcatcaacctttcccttcttcttggcgtttacgtcgtgattgagggcaagcacaatagcccctcccaccagcggtcctccagtgcgaaaccacagccagatgttcatatatcgccctcgcttcgacggctcaggatatcccagggcgacggctccctcactcgcccagaacaacccggccgatatgccacaggtgacggcaccaacgaggacgagccattcatttccatatcgattgttagcatagagtccggcagagtagacggggtagccgatcgctcccaggaatagagtccaggggagtccgatccgattggcgattgggccaccaaagaggcagagaaatcccatgagcccaaagactagggaattggcggcattgacaaggtatggggattgcgctcctcctgcacccagagagctcatcgcattccagagacctggcgcgaggaaccccacggcgcctatcacgaaggcgttgaacaaggtcgttcgataccaggttcgcgtctgtgagagcgaaaggctacttgcatcgttgggcagcaccccagcagcgtcttccctatcattgctggccattgttgatgttcctctttcagttaatccaagatggtcaaggagcgagcgatagctaaatacggcacaagatggtttagagtagaaaggtacagtgccttgcgacagtcgagtgactttattccgtaatgcagaatacaatcgcgaattaccagtgccatcttgaggccatttcttcgcaagatgacaccatcgcggaatgcaaagaatccctgcaaattatggaccaaaccacgttaattccaaattgaatgcgtgcgatttgtgcttcgaaggcaccacatggtgatgttaggtagcattgacggcaagaccatgccgctcactgcctttttagtcgacactaagaggacgaagctcgcaagagaccagaattccgatcattggttcgctagcaggagagaggtgtttagccaggacattcttctacttaaaacactgctctgcctgtatcctgaccttaaaatccagaacgtgggtactttctcgcctgaaccactaagagtgttatgatggttattcttcgaattgccaaaggacgtctgtcacctctgtaatgttattaatatacttgtaggtattagatgtactgcatgtccggctctcacgaataaaagcaaccacctgctccgaaaaaaatcttataaagtccttcctcaatgtgtgattcaggtatgtgtctcttgggttatctctatcttactgtatcgagcagctatatcttgttggatctactcctgctccgtaaggcaaattccatctacgctgatccatacgccctactagggcctcttccatagctccttgccgtccagtatggcagtttctcgctgagatgtggttcatgaaagtcgattacattctcgacgccaaacagtgtgtagactatgcctagctatgcctaactctgtggctatggacaggggtttttatgctattccttgctgttgaatgaagagatctattagagagagccttgacctaatgttagaagaagtgctattgctgctctattatatatatgtgtgtatatatttttcattaataccaataatgtagcggctaacagcgtgtgcagcccattaagcacataaatagtttaagtgcggtcagtcaggtgaccgattcactggatacagttctggatactacctcgtggatgttcacacttgggaacattagcaaaggcagtgaatgaatgcgctggcttcggcaaactaagcgccttcctgctcatctcgaaagttgcttcgaaaagaataaagccctggaaaatactcgagatttcattgtctcacatttgatagctaaggaaatcgctcgtcgggcgataccggcgcgattgatggcacgtttaccctcatccagtgggcaagcaggcgacagctgcaatgaagaactagatgatgcctatgggatctaccggctcgggtccctttgcgtcacaaagtatagaagaaccaaggcagcatcggaactacaaagagccacccaacactttcgagacgcgttatgtcagatgccaacagaccatcctcgacgtctagacgtgcttgaagacctaggttctagttacagtgccctatttaaaataacaggagcactaaattatctggagaaggcgtcgcagctcagccaggaagtcgtcgaccacaccccacagaaccatcatgaacgtgttcctcgtttattggatgctggaatcgatcatatggatatatatagcaactttggtgacgctgcgcacctagaactagcctttgaagctttttccaaggcactcgacgctgcaaaagagaatcatccacgcctccacacctgcaattcaagtctagcaattgcattcagataccggttcttcaaggacggcaacatgttggatctagacgcggctatccgacattttgagcgggcccttaatctggtcaccatcaaccatcacaaacgagtacgctggcttcaagatgttggcgcgtgctacggggagcggtttcggaaaacacaagacattgcagatttctcccgagcaattgaaagagctgaagagtccctcgaaacggaaaaggacgacttacaggctcgtgcacgtggctatagcattctcggatcaagctatggactgaaggctgaacaaactggtgccatgcaggatctcgagctatgcattcaaatgagccaccgtgcactggacataacaccgcgcgactgcccaaatagaacgcgtcgtctacacatccttggtgcatgttacggcaccaaatatggtagacttgggataccaaaggatttagatatctgcattgacagatatcgagaagcgttagacaacaccccgcacgacagttctgatcgtggactacggctttgcagtttaggtggtgcatatcttgatagataccaaagattcaagtcttgggaagatttacatgatgccattgaaggattggaggaggctattcaggttacagttactccaagcgaccatccggaccgcgctcgtcgcatccacaatctcggaattgcatgtcaagaacgatatcttggaataggaaagacaagagattttgttgttgctattcagtatctaaaagatgcactcaacctaacaccggccgatgactgcgaccggcccgctcgctttgataccctaggaagcattcatcatgcccactataaaatacgtggtgagacaggagacctttttaaagctcgagactattaccaagaggcgcttcaaattacaccaagagaccatcctgatgagaaacacaggcttggcggcctcgctacttgttatcacgacttatttctaagtgctggatcgttcgcagacatagacttggccattgacaaatatcgaaaggcgcttgagttgacgccaagagacagccccatgggctggtttcgacttcacaatcttgggatggcatacagggatagatataggaagaacaagaatgtagaagacttcgaggcgtcaatccaacattaccaagcagggcttgaccacccaacagcctttgcagcggatcgattaaagtctggccaggatctgcttattatctacgccgatactgacagttggacgtctggatatgaaattgcctggaaaacattgtctctagttccactaattacccctcatgccttgagaaattcagacaagcaggctttacttatgagtatcgtcggcttgtcatctatagcggcgagtgttgccttgatggcgaacaaatccgtctttgacacaatctcgtttctagagcttggtcgtgggatcatcatcggctctttgcacgatatgcagacagatgtcttagacttgcgccaagttcattctgacctagcggaagagtttatcgagcttcaagagaagctacatggcccaagcgctttgacaaccttcgacgagcgctataaggcaggtcagcagtatgaaatgttgcttgaaaaaatcagagacttgcccggtttcagcgagtttctcctgttcccagcacaggatgatattaaagccgccgctgcttctggtcccattgttgtgatcaatattagcgcttacacgtgcgatgctttgctcattgagcagcatcagctaagagccttgcctcttccagacttatgtctagaagacattaaggatcgtgcaactacccttacatccctctctatagatacactggagtggctttggaatactattactcggccagtgctagaggccctgggccttgatcaagcggccggggacagttggcctcacgtatggtggattccaacagggccacttaccagctttcctcttcatgcggcaggcaactataatgatgacatacccgacacagttctcgaccgtgtaatttcatcatacagcagctctcttaaggagataatacatagtcggcgaaggaataagactcgcgatgtacccattggcctcaaacaggtggttttggttggcatggaagaaacgccgggccaaagccgtctcgaatttgcgtcgcaagaagtcgagcaaatcgcaaagctttgccactttctcagttccatgtcagcagggccaagaacgaacgagaagatgtcttggctcaagtaaatgactgtgacattttccactttgctggccatgggatgagtaacttatccaaccccctgaaaagctctctgctcctttccgacgggcccctgacggtgtcaaggcttcttgaaaccgatttgcggattcaaagaccattcttggcctatctttccgcttgtggtaccggccaggtgaagcaaaggcggcttgaaggcgaaggaattcacttgatgagcgcctgccaggttgccggcttccaacatgccattggtagtttatgggaggtcaacgacgagtcttgcgtacacgtagccatgtcaacatatgaatggattatcaaggataatctaagcaatgattctgtctccgagggacttcatcatgcatgcaggaagctatggaatgaatggatgtctaaaaactcgcttgaagctgaaaagtctcgggaaccaggcgtgaaagttggggacaaagacccagattctattcaagatgtcctctcaagcataaaccggccaagagacgcaagggataccttgtattgcggtcattcaccgcttctctgggttccttatgtccattacggagtctgaatgtgatggtagtatttagttaatttacgagtttttcttatctatgtagagaaccacagaacagtgtgagaagacttgagcgcaagaagaatgtcttcaagatatcatcttgcacactttggtatcatagcagacaaagcactgtgtaataaggtcaagttactcgctaaacggtctaaatgaccgtcaaatccatcgttcagatgatttccagtctaaataatcagccgggagcgcaaccaactaacattatcatgatgacatcgcaagtatatacttgtcctcaaggaccgctaagcagggtcaaagaatttgacaagctaaactggaagttctgtccaatggtaacgaccagcggcagagtctaggatgccgttgctgagcacgcctccccaaaagtgatccgcaggattgttgtttttcttctgattcacagctagcgtatcagcgccagtgctctgcttcaagaggaggccaatcatgccgatattctttgtagttaaggctctttgaagtagagtatgtccacccatgtcttcagcgccatacagagaggctggtttcgcagagaaggcagccttccactcccagagattcacgttagcgctatatcgaacccatctgggtagcaccgacggacttgtcgtaaacgaaggatactccctaggcctttgctttaagcaaggagaattatcgagtacgcgagaagtggtcaggctgaaaaactgtagcgcagctaagctctcgtctctgagccccgcttgtaggcggcaaattacagcgcggacacagccaagggccgaccaacagctgacccgtcaaccatttaagtgttgtgggtattatcacatactcttgtgaagagtggcagttggaggtggccacagcgcacatattttcccggccttcaagggcacagccaagcagctgccttctaaaaagccgcggtatgagggtgggtacgcaagaatccacgagtgttccaatacagaactatttgcacccgagcataggtgccgtgctgagaggacaccgcttgatcgttatcgtcccttgcctgttaacagttggaaccccgaatattcatgggctttgattcgggccatgattcgagaggacatgtttctggtaccagggcatgtagaagtcctttgcccatcctgccaggaggcgaaggccagcgacaatctggtacgtcttgagaatgctctgcgtagacccaaactcctgctcaatccacaagatggtgcgataaactgtgatattggtgccgtcttccagagttgtggcctgaggctccaacgtagaaaagacaaagagccaacgatgaccttgtatgattactcccgggaggaaaccgagttgggacaaagccgccttcgcagcatccgtgatcgcttcctcgtctgccccatcaggctgagtcgacgtgatcaccgccttcacggcggactggagaaacctccactgcgctgcatgccatacacccatctgcagctgtgccgcgtccaaatccttaccaggacgtttagtttcaatgctcagtgtgatggggcgtagctgaagaggcctgtaatcggtgtggttgactgtctgagtaactgtgcgctgagcaagtgctcggcgcgcttgagcatcgacgtcggactcatcaaagaggccaaagtccaccatcttttgccttgaagaacaaggtagatactttctatgtggccgggcggttgtactgaaaatccattagcctctaagaacgatacgtccttttctcatcatacgtaccatgacatgaagtcgaagggctgggcggaggcctcccccaatcctctgaagatgctttcaagcagccgatgatgcacttccatgttccagctgaattcttcgtgatcggaattaaagcattccatcgcccgctcacggacagtattaagttcttcccagctcggcacgcggccaggcagagtatctacgccttcatccttgaatgcagagcgccaaggtttcgtattcaacccttgttcctgaaggatctggatgagttcgcttttcttttcatgcggcaagatgtcaatccccatgtcgatctcaagcagctcctgcactaaactagccgccgcgaggggaggatggtcgttatcgagctgcttgcactcaagtcctccgatgtccaaatttaaacccatgaattgtctccggggcgatgaagcttgtgaacgggtgtctccctgctgagacggtggcagggagatggacgacaaagaactcaactgagagcctgtccgcgcacctttagcttggggtgttttgtcgtcatcgccaatccttcttctttttggcgtagacgtatgctccatcccgcttgtgccgcccgctgagtgcggaggagtgagtcgctggcgtcgcgattttcgcttgcgcggggctgcacaatcccctccggggtggtccagcacgttctcaagccagagatgaattcggctatcgtctaacatgacggaaaaggaaaatgttcctccaggcacggcatcggtatgagaatagcaatttggctgggtgaagtgagttagctggaacttcgaagtggaacaaacattaccatagcaacgtgcaaggattagttcgatgtgctgtacgaagcggtgattggccagggtttctcagcttcgggaactcggtttcactataatccggattttccctactctagccacaaggcaagccactcgaaaaataatgcttggtaagcagcgcaacggcaagcctgactcctaccctataggccaggtattatcaagtgaaggttgaagaccaacttagcagctgttatgattcactttattattagatatatatccatcatgggacgagagctattccatgtttattctgtctttctcttatcgaatcttattgtgaccattagtagagacataagagaccttgtgttctagagttgttcagttcaatgatgccgtcaagagagtgcgctgcctttttaattagcgcaagcaatcgtcattccctatcaccgggaccattccaactgtaagcccgacagccattcatcacgatgcctcccacagatcctactgtaatgaagtctagatatcaactgctgcattacggatgcctggtgcgtgggaatgaccaattactggtctctatgaacatgggggaggcttcctggtaattacatatcggtgggataagtgggctcaaatggtcgaatgggaaaacatcattggttgacattaaaccgttaaatgaattcgcgttccgaatgttttcaaacagacttgaccagtcaaaagccaggacttttagctccagccaatcaaaatcatgcaatgtgacgcgtcaatctgcgacaaagcgtttcctgggtacctgaatatttaggtgacaattggccaagccagagatttctgtgaccccatcaacagagccaatggaagaggacagagcaactagatgtcatcgcatcccactagagtcgcatgccgtcggaagcccttgcaggccaccaactccggatcgcggctccggctcattacttaggacagccaggtcagcttcgtaccaatcgatcgccttgactgaagacaggcagtcaggcctcagcaatcgcatttcagcaatacagcaattgctcgtctttatgagggacagcttggccagctacacagcgatcgctcgaatgggattgcaactttgacttgggcgattttgcagcagcctttaattttgaacctccacagagtcacgtgctcatcaaaaaggaccacacgcagagtgtagcatcattgcgaaggcattggcttgccaacggaaatgaatgtcggtgaattaccggagcttgtattgatatagctagatacattcactacgcaattagattacgaaggaggaagagcgacccgaagataatgatacatgtgaccaccaactagttaagcgttgcttgatccttggattcttccttgagctctcgcttccttgcctctcgtttgaagccgatatggatgccaatgaacatgagaagggaggcgacggcaaacccaagataaggcttggctccaatcttccagtttggcgcttcagatgcaggaaaggctgcaatcgggagaaaagcgctgagtgcatagaatatgattgttccagtagcgaaaagaagtgtccggacttcaggctctccccgtaagtgatccgatgcccacgcgcacaacagcatcattgaaacgctaatcgttattagcacggttgtgattggtattgtgatagggtttcttactctccaatgtagtttaggtaatatccagccatatgaagctgtctattttggggtcgagcgataataatcgacagtgatgtaagactgattgcctattgcttgttagcaatacctctcacccatatagtatagtatctaggcctgtcttacagaatgcaatactaggaaaggcaacctttgaccagtcaagtcactgaagccgctgaatagtaactcagcaactaattgaacggcttgcccaataataggtagatagttcaacatggctaccgagctgctctgtctgttagcagcctagaggtaagatcgttattatagggagactgactacgtcaatgttccatctgagtttttcagagattggagataaaggttgaaatagctggttggcgcggtgttgccaccaaatggccatgcaactgggacagttagacttaatgacaatttgttgatggttagacagtatcttacttgcaacagcccacagttcccaaaacgtaaatgctcttatgaacgacttgactgtgagtcctctctgaggctctcggccgatacggcgactacgagcaagtgcaacatcttgaaacaaaaccattagcacatccagggcagttcgggggactgaggtgacttaccgtagtcctgtcgcctcagataccagctcgcaagcttatttgggcgctcaggctaggtgtcttggttaggttctcatcctccttggcgacatttgtttctgaaacgacatacatatccaggtaaaaggacgtatccaagaagcgcaacaacaattgtgcaaacgccctgtctgaatttagctcaataatccaagaattgtaagcttgtaacgcacattgataataaaggcccatctccagccgcttcgattcatatggccttccaagttggtggacaaagcgccttgcattgcgcctgacagcatagccccggccggttgagccatattgtagatgctcattcggagagcaacttcgttgggcatgtaccactgactgatttgtttcaattagactcctcaccgtaatggctagacagtgcaactcatacctgatcattgtgaaatacgccggccacatcgtcgcttcgcaaaacccgataaagaagcggattccatatacctttcgatttgtgagcatttttgaagggaattgggttcaaagactttacctgtcgtgcatctgtaactagggacaagcaacatgtaaggactccccatatgagctgaaatgaatattagcatgctgggttgggtgtctagatggacaacatgaagaacaaacttcgcaggatggaagccaaatagcaggtccaatatgagatataagaatacaagaaggaaaaagcattatcatgtatccgatactaaacagtgatatgttaggctgggcttgttcgactatggccaacacaacacgacaacaacttacttgaagaatgtggtgaaatagttgagctcgtttccgtataagtgtaaatccgtttgcatacctgatacatacgcattgctcttaatcaggaccattagcaaagcgatattgaaaaatcctacccgaatctactcacgatgttggtctggtctatatacttgaacatgtagctcaagaacccgattgtgaggaaccctaggtcaagtctccagcggaattggttttccgcaacaggatcgatttcatcgtcgctctgatctgttgttacagccagatccaccttctccttggtttcagcaatatcagccgactgagtagttgacgccatgattgaagtcgttcgatgaactgagtatgtgtgcatttgtttaacgatttattttattcccatcgtcaaataaaaaggaacttcatcttttatataaatcttatttatctggaaactcatatacttcggtgagatggtgtcatcggccagggcaacggtgtgctccaggagtcgtgtgggtacaagcccacatattcggtacgctctcacaaacattcgatttcttattatcaatagaccccactccgtaggaatgcaatacgggtttgtagatatagtgtcggtttgttcaacattgccgagcgcagttggtacaacatggtcaattcctggctgcaatgatataagaatggttaccaagttgtcatcagatgtagggaggcaagaaaagccaataatttagcatattaatgccactatcccaccggcaaacgttggaaagctcattttaaacagcctactgatactaaaatagcatatcatggcatttctccttggcataattaactgttagacttcgtaagccgcatcaatattattattatatcaccaaaagattctcgcgtagctatggctgttctcctacaacccttcattataaattcatatcagagcagaatcatctatttcaattttacctaactcaactgatagcggattttctaggcatctcgatgctcgtgggttaaaaccgctttaatcctcgagacggctttcatcaagatcccaaattccagtaaacatatctggccaaggcacttgattatcatctaggaaacttccaataactgggttgtcaaaaatatcaatacttccactacctatagctttttcgggtgtgctctggatgccttgattatggtgcaagttggtacccgtttgaaaactttgcgccctgttttccgggctatcctgctgatttccaccggattccgcagcttgggggctgtcgcttgacgtgcaagcagtgactaggttgcccccaagttgacatttgttccgtagaatggcgacacgctcctgaagatgtaataacctctcgcaataatctacagaaggcacatttccatccttcttcatagactgcaatacagccaaaaggacgcttaatgcatcagaagtggcagcatctggctttatggctagtgatattaccaatatcagcgcagccgaaaagaagtggtgtgcatcccagtagccaaacgtcgcaagggaaccatcaaggaagagcccctctgcaatccggctcgaagcctgtgccgcttgaacacagctatcggccaatgcgagagtgatcggtgaaaggttgttgttcgatcgttggtttcgtggagctgtgctgttgccattgggtcgaaactgagctttgaataaatgcaaatgaatcggtctagtcgtttggatgatgcattcattatatgccaagtgtagactcaggacgggtcgaggcgtgttttgttctcgaagacgcacagtcggttctaattcatcatgccatgctcgtaatttcttaaagatcgtgtatactcgatgtatatataaaccatttgtacgctcaggaatcccataaatatctgttactatggagaaggaatcagctttgttatcgatgatggcaaatagggatgggagaaaaccaacaaatattcccaatgatgcgacccagctttacatttgccaccattggtataggatccagaaaatcagtcttttcttcttccgttaagccatccatacttggtagttcgacatcaatgtccttgtccctgatggttatcggctggccgagtttggaagcagagacacgttcgagaaagtataagacccaccaagtacgtcggcggcactctctttcagctgggctcaatgtgatgagtttggaggctgacctatgtagacccatactcgtcgcgatcttcatagcgttgccgatatagctaaatgcggtcatgacccgacccagaatgttcgaagaccatgcctgtcgaagtatgtgagattgtttgcaggaaaaataagtcaggtattataaaacgtaccagtagtattaagacctccacctggagcaacgaaggctcctcaaatgcttcccgaaatatattcacagctttgatataatagtctgttcctggaactctattatcacccacccctcttcggtttgtatagatttctcccaagcttagcaagctatagaacttgcatagccagagatctgaaggcattacctcttttcggtacactacatctacttctctcataaacgatgcctctagaagtgggagagggtaactaccaatgaagcgccgagcaacattcagaagaagccttgcatgcgtactctcgggaaagtcggttctgggatccaacggcagctgctggtatttggggactcgataatagttggagaatgcaacggttgccagaggatggctatcgtcaaggcattgtaatatcctattgtggaaggcagcgcaagaagcttcaccaacaaaagctggctcagaagcccgttcgtaaatgacgttctctaattgcccatcaaagatgggattaagcatgctgttttcctcacgcgaaagagtcggagatatgtcctcatgctccttgtctgagaatgtctcttgattggtctgggtgggacgttggttgctgattctttcaagacgtttgctgtccgcttcgagtttctttaaataacttcaattcgattaatttcagtaattaaattagcgagggagggccaaagaaaggagattacctttccgatattgtgacctttcgttctttgacagggaattcgcagttcccttcgtcactggatgagatacatgattggcatgggcggctcccagaacatttgatcttgtgcaagtggcatcgatggcagctggagcagtctgtcagtacgatcaaggaaatctacaagttttacttacgctgcgattaatcttttcgcttttcgacggccctcggcgttcatatcgaggagtactgtaaatgggttctgggaatcaaatgacgctatattacccctgtactgctaatgctggtatcaaggtcgtcagagaaacaatagcgaatggcggtttattggcttcctctttaccggtattcggtatcatgctacgaattatttcacaaagattcagagacttctgttccccccaccatcacgtacagaagctgcaaacttgctactaagcagagcacgcaatcgttgttttgaattgcgcttaccgaagtgtgggtatgctctcggtaactgaaaagttgccgatcatgcaccaaattattctcggcgttctctcggcttcaagtgatgatgctaacacgtaacaaacgtagcgtctgaaaccaaatgcggctagttattaaattagtcgatggacccacgcggttggaagcggcaattacttgagtgcggttctgaccagcaaaacttggtctagtagcctcttgttaatgtgagagattcaaagacgggcacaggccgctggccagaccccatgataaattcaccctgtatctatctgacgaggtatctgctatcaaagctgcaccctagcaaaataatgcattaaaaaaaacccttcattgttatggctatctgcaacgctggaaaccgtttcgatgtatcgtgagttattggttttccccaaggggaacacccatgccatgtcgtccggcgtaagcagacttctctgccggcgcccagccgctcgtcttaagtagattgtcatctgcaaggcggaagacctccaccttgagagggcgacagcacttaatcatctcctcttcgctatcctcgccgaagccccagagagacaagtcaccaccagggcacgtgcctaaaatcattagcttctgggaaacagagcatcagcagagatgaatggtcgactagacttactgagagccatgagcaaatcctgctcagcaaggaactctaggtggtcaccaggttcagcaggcgaggggttcatgaaataccgaccttgctcatcaaggccagtaacttggaagatgttgattacatcatgaacatcttgctcgttcaatccataagggataactgctcgtgtcagatttgaatggcactgatagttgtactggcctccgctcaagacagcattaatatacgggtcgcagcgagtgcctagtaggtcatgcacccgaccaccatgctcatcttcaccgtaccaggagagcgtgtccttgattatggtggcaagaggacgcatgtagggaaggttagaccaaagtcggtcataggtcgagacatgggaggcgtgaagctgcttggtgcggcttgcccaaaatcgctcccgtgggttatggaagttccagatgttcaagtcccctattttaaagaatcgttttgtcagcatctgctacttgatcaactaacacagtcatatctcgcagaaatgaaaccagtgtgccaccgaatcaaggctatgccggctgtccattcgtaccaacttgagggccttcgggggtgctgattctgacaattgagcctgccggggccttccatgctttccctgaccggatgggcaacgtgaactcttcaattaagactcttggtgcctcgcgaagcctgtcataaagctcgcggttcaccttgagtggggaggcatcacttgaaggcaagtaagctggaacaggtttggggattggtttgcggttggcgagtcgctcagcgtctgatgcgggcattttggcggtggtgtgaatctttgagttgggacaatttcaccaacaaacagacagtaaacctcgcaggataaacttatagatggtggaaatgccccactaggcaaatccacttcggcatgtgaatagttgccgctgataacagcaacggccgacgctaaaacattatcagcggatgctcgccttttattatggcgtagagctcgtaatagggtatcaacaacaagaggttccccctttttggttcattagatatctactatgaatgatacagcaatgctgatattaagcaagcttgaaacaacggcaaaacaatgttccgggacgtaatacaattacttcattcgggttaatggacaatcggagtactcctcaccgcttcgagttgcagcacagctttcaatcttagttatttagcaataaaacactgtcatgaaaactctagccattaaaactcaacagaaatcttttctattggtctccagaatgaagcaattatttcttactgtacaaagcgacaagctggccctaaaagagccagaaagcgaactcaggatcgttacaccaccccgacatgaggctgatcatcatgaatgggagccgagtcatctggacgccatctgcgttgaagagttcattgtcaagccccccacatcctctgccataccctcagcacccgatagcagaaggcgacgaagaaccctgcgctcttcaaggcgcttcacaaaccagtatcaactatccaacgacaacggcattttgactctgaagaaacgggtgctcagtttcgaaaaggttctgctcttaggagtacacgaaaagaccatacagcagccgggaaacttcaacaacaacccatcgctgctgagacttcctgcagaattgagacttcgaatctatcgccatcttctacttcgagctgcccggtatcctatatttcgtgggtcccatgacttccatatccaaatcggcgattggagaatggaaagatgtgccggcgagctatggcctgaaatccttgcgacttgtcgactcattcatcgagaggggacaccaatactctatggagagaatatgttcgaacgggtgttctcctggccgtcgaaacgtctttttagcagcattcccttgccccgctctcttacctctaaacttagcaaggagagcatatcatatatctctgcaatctggcttgcagagaagccggacatgtggcttgattatcaaagagagctaaaagtctttcaagatttcccaggcttacaacagattgagtttagtaattcatgttgggcattaagtccgcaagcgcacaagggggagagaatactgctggaagattgcctgaagtcagtcgatcggaaatcaacacctctaaagcggtgtagcttctgccttcgtcttccttgggatactaattggaaggtttggtcaagaggagaagcaaaagggtttggtccacatctgaaactgaaagaaaacgtggaacatatcctgaaagtaaactcattgtttcctcaccaaaagattacatggagttttgaatcatcaatttcggagtattgtggacctgatggctacgttaactttataattgaggatgctagaccgggcggggaaggctccaggaaaccagacatcaaatgcacggttggtgtcgacggtatagattctcatacaagcgtggaggaccctgtgtagcaaacctttgggccgccatgtacccatcgttagttgtatagtctagttatgtcgttgagctaggtttgctgcttgttatcatagcttgcctattcaatctccctcaacgtcccccctccccgttctaccaatttggctgctatttctctcggatgactagagaacaagagtagacatgagttggtatgaagctctctatctgttcaacgaagattacaactcagacttgcggcatgtccagagatggctggctcggaaagcgctcctgcttcggggcttatgattgttaaataatctttatgtgtccaacattatctttcacaacgatctccgttccaaacagcttcgaagctttctgcaaatgcgctaaaatacgctgcgcttctgccgctggcgccactttcggcattgtgcgatctgggagagatgtatcgcttgtcaactggttatgcataaggggatgcaggacaaccttggccggcgacccgttctcaaacttggtctcggtaatcattccgtcgtcccactcgattggaagattgtatccacgaaacgacggcccgagactataagtgagagaccccaagccgtagaagatggggcgcgaattgtagacctcaatgcctctcagagtgtgcggtccatgtatcaacaccacatcagcaccagcatcgattgcggcatggctgatgtttcgtgtgtaactagcaggtacgcttgaagcgggcgggagagggatatcggagtctgcagcgcctgattcagactcatgagcatgcagcgagaagattgtggcgtcggactgtatattcgcctccttgattgcatccaaaatgccagtgtagtcgtccgggttgatatcccacgagatcgatgatccagactcttcacccaacatccagttggaccagacaatctgagtctggccagtatataacgtgatgctagtctcatcacctgccaatatttgcccttgagacttggcaatgtttcgaatctggtcaaatcccgcggcgtcgacgacagtgaagggggtcgcacgaagaacgctgacgccgggtcgaggccgcaagtgctcgtctggatctccaggcccagcaacagattggggtgtgtgcgtgcccgctgcactcacgagtgccagccgcctgttgcccttggtaacaaacaccgctcgtcgtgcttcgttgagcccaataccagatcctgacgtcgagatgcccaccttggcgaggttctcatgggtgctgatcatacccgcctcgacaaagtcccaagcatggttgttagcgtgggacgcaaggttgaaaccgtacttggcgagtaaggcagcttgttcgggtgggtagtacagaccgccgcctccgcctccgtagaagttatcaccgccattctcagaggcaggatacccggtgaaggtttcctcgtttattatctgcccttccatgttaaaaaaggcaaagtcggcggcctgggtgatgttccacaccgcagcagtgcgagtgtcatttgtagcgactatatccccaatcaagtctccagttgctgctagtgtccatggtccggagtttcttggagctgtggcgacacagagtggccattggaaagccaagctggcgaaggggagcatcagccagcatgatggtttagcaaagaccatgactgatgatggctttgaatagcaacgatacgccgggtctgaacacttggcttgtggttgttctaaaactattcgaaacaattggtagtatttatggactgtgaagctgtgtagaagtggcccctgctgcaatgaatgtcactttggctcgtttcttgaatgtcttcacgcgcggccgagaatccaaatgcgcatccgtggttgtctctaggccagatcatggagcagagcccttttatcagtgtcgcttcgctgacatctttctcggcgacagactgcggaccagggcaccagcctgggtcagcttttgctgatcgcagctcagcccggcactcacttgagaaggggttcaaaataaggttaagatctacatgagcagagttataagatgtggttcgggttgcggtgagcttctccatctcacccttccatttggacaaaaggagttattgccgagagctgttgtgaatatgatttggaccaaggcctttgctctatctttgcaggtggcctgcgcgacgacatgtgttgccaaagcatcatcgccaacaaactcaactttgccatcaatcgatgtggtgctgactcctattttgggcgtggtgaatcacacagacatcaatggagagcttgttatggacatccattttgctagcaacgagaccctcctcggactgcctcttcaaatggcaaatgcaccatctgcgcaatataccaccgagacactggaagcgcgggaccgtcttggccagctcaagctgacccaaagcgacggcactggatcggacaaccagcccagcaggttttgggctgtatagagagccacacaagggcctgcggtggtctgccccaggctctggcctctgcaccacgggtttcggtgcgttacctgatgcctagcctctgggattgccacacgcatttcattggggtattgaatgtggactttccagacttcatccagacccatccagctgcaatgggggccgccattactcgcggcctgcatcaaactctcatggcggggattacatcagtacgagatgtgggttcttacgccactgaggtggctcccttggtagagaaaggtatcatcctcggaccgagcatctttggagctggaggggggataggaattacaggcggaagttgtgacgcctgcactttgccctccgacttcgtttactcccgccaaggcacagatgctagtacagtttggtctggcgtcagttgccttgttctggctgacggagtggatgaatgtcgtcgtgccgtccgccagcagataagacgcggggcacgctgcatcaaaattgtcggcactggtggcgtcctcagcacccaggataactccgagtatcggcaatactctgatgcagaacttggagcaatgattaaggaagctggtctccagaaccgatctgttgccgttcatgcacacggcaaaaagggaatcattgctgccgtcaaagcaggcgctcacaccatcgagcatggcagctacatcgatgaagaagtagccgatttgatggtggagcgaggcgtgacgctggttgcaactcggcacgtcattgaagccggcctgcgcaatctcgacaatcttaatccacccacagcgaagaagatggtcgagattgccggatcgcatctgcgggcgtaccagaccgccgtgcgcaagggcgtcaagattgcgctaggtactgacgttgcggcatctgacccagcatcggatactgcacatggcaagaatggcgatgaagtaggttacgctgtcaaggcaggtttgacaccgcttcaggccatcgaggctggaaccatcaactcggccgagacgctagggggatgtgccccaaagaagggtctcattcaggtcgggtgggatgccgacttaattgcgcttgacgaaaatccacttgataatattggactgttcggtaaaccatacaacattcaatatgtgtggaagggaggcttgctggtcaagtccccccttggtcaacttctgtggccacctctgacaaagtcataactagcaaatgaaactttcgtatatacggagatatggagaaatttcgaatcatggcatgaaaacttggatagatactgttggatattctggcatgaaaaaccaacctcgcctactgttcttactcagtaatgcagatgcgcacctagctgacttggctgcctgcttgttgttgatttgctagataaactgacctcctttttgacgaaactttttcgatgggccgcatgttctcccatgactagcttcgactgagagcctttttcctctctacttgtttaacgaaaatctctgtctactaccttcattacagacagactggggactagccacaagccctggagataattgtagtatggactgaaatacaatctagcgacggagactagttgatggcatagatcttcatccctgggagagatggatcaaagaacttattggactgactcctggtcaatggagaggaacacctttgaagatattgatatttattcgaacgccctgttcagctttctatcatgctttgcttgcatccaagtgagcagtgcactctatctctacatctgtcccaaaaggcaactggtgaactgccacacatgttctcgcctaattgatgaaggttatgtcagcagatgatcgaccaggataagatgagagcttgaagttacttactggcttaaagtcccacttgaagaattcatcatatgcctcgtttacaattccaaaattgtccatgtttgtcaggtaaatgttcatcttcaggacattatccagactgctcccggaagccttcaagacggcttggatattggagagagcttgtctctatggggatatgattagtttcagctgtcgccatactatgcgatgaactacttaccgctcggtcttttgccgttccttctactagctctatcgtcgctcctggcttaataccaatgtttcctgaacagtacacgagcccgttgtacacaacggcttgcgagaactggggcaacggggcaggagcctcggtggtaaatacaggagtgaaggaattagccatgttgttttctggttaataaagggtggtacagaacagtagtattctacgtaaagaagtaagcaataagaagaagcagcttagtcctccgtaacgtcatcttatatctaagtaacaatcgccaacccacaatatcagcggacagtataccctgatccgggctagtcgacaaggcgccggccgaagcaaagcgcctcggcttagagatccagattagcatgcaccgcctggacagcccaacatgattccgaactgatctcccccgacacgagcgatctgtagaacgcttaatatgacatacccaataccctccccagcaataccgcccgacgcgacggcgtaaacgaatctagcatatgactttggccagaatttctgccatacccaagaaaggactgagccaatggcaaccgtgatggtcatcgccgacccaggaatggtcattgcgagaccaacaagcgacatgtttggaactaatgcctcccacttcttcaaattgggagtctgcatcaagtggcgcttgagtaccaccatagccatgccaacaaccgaaaagatgacggagaatatccagctggactgggcgattgggaattcaggtgccaagatggcctctgtaacaacccgccatgcggtaaccgaggggagagcgaattgacaggtcgttactgacgcatcggtgatgcaagggaaagctttggaaaatagcatgaaaagggcgggggagaggaacacggcaacaagtgtacccagcatctgagcatgccattgtgcgcgagctggcgtgcctagcaggaatccggtcctgaagtcttgacacagttcgccagcttggttcgcagcggaagcagacaaaacggagccaacgaggttggatctggcagcgtggtcgaatccaattttctgaacagaatcccggctaacagctccagttatgaactgtgatcccttggcaacagaaccagtaggattggtaccagaggctccgaaaacttggatcacgacgaaagcccatagaaatcccagaaagacattgaggaggaccaatgtaggaggcacaccatatgtgtacttgagaacgaccatggcaaatatgaaagccgcgacagtgacggatgaccattcccaccagcgaacttggtgttctttcggggcaggatccataatctcaaaatcgccgagtactggcgcccttgggaccgattttggagcattgctgctgacgagtcgctttcccgtgagttttgcaatcgaatcattcatttgttggaagccatactttgctaactttgcgaaatttcgtgtctccagggcaatcgttgaaattgaggcggcaagcatcatgaagactgctggccacagaatccagtaacgaggtgagggtgctgttttgagctgatctggaacgaacgcattgtaggtgacgaggtctggatttgtgggatcgtaaggaataccagtagcctccccttttgcaacaagaattggcccaatgataccccaagctaggaccgtaccaaggaggtacgataaagattcattaagatcaatgagtataccgaccccgatcagagaaggtgaccattgccacgatagccaaccccagttgactgcgccaattatgccgtggccgccccaagtgtaaatccaccagaaagggttccatgagtacagaataccgggggcgtaggaggaagccacagaccataccaaggatgctgagaacgagtagctaatcatcttgagcttctcttttgccccagaagccccgtcggaagctgagtggagtgctcggatggtgatggcagatgccgtttctagggggaagtagagactgagttgccgtgctagccgcggaataaacatccgccggaggggaaccgcgaagccaagaccccagaaaccaccgaccagtgtcaaacatatcaaccgcccgtagtcagattggggatctgggccaaggagcttcagctggtacattgctggcacaccgctcatgaacataaaaccgacgccgatgcagcctagagcagtcgcttggatgatgttgttttcatgcagaccaaagtcaccggagagaagggggatctagacatcatcagacaacgttctgtatgggatctttcatggcaccgacgtaccttggacttctcaagcatcttgcatatgctgaatccgaaaatagcagagaagagagttgcgtcggcaccaaagccagacttgaggcctggttatgttagactttgtatcagtgctagaatattggggctattgcctaggtataaatttgagcaggcaatcaaggagccaaggacaccaccagtcaagatggcgcgaacggtaacgagtctgcggccgtcgtagggcataactcctgggagtggctcgtatggctgatcctcttcgctctcagcagcaataatgcttgcaccgtcgacggcgcctatggtgccatcttctttattcttgtcaaccaagtcgagggcgacatggccgtctttctcgaccgggacaattcgggcgcccatgtcagcgtaaggtgcgaacaaagatagtcttgggtcttattgtatagagtgttcatgtgccctagagggttctcagagtaggatcgcgggagcgttgtcgtagctaaattactatatattcgtatcaacatccgaagaagatgggtggtaaacagatgctctccttgccactcagttgtaaaaacagacttgaagaagcttcaaactgcttataagaatcacacaggaagctgtttccaggcccttaatcatgtatacatatagtagcggatcgacggatggtagcgttcactttccagatagagatactccattacccattatgtggcaacaagtaaatcaggttaatgatacttttcttatcttgggccatgtattttgagccagccaaggcttagctttaagtacttactcaatgaggtctacggatccgcaccatcacgcggggtatgcagaaaattcttgctacctaaaagatagatacacttgtaattacatcagctatttgcctgagcctcgaaatggatctccgacatatcatgaaagcctcattcatgaactaggtgctgacatcagcatctcttcgacgagaaggaactcgatgcccaaaaaataatagaacaaacggaattatccccactaataatgatagaaaccctaataacgatgatgcccaaggaacgccgaggttctggtacattgaaggccccccaaggggaacgagaattgcacatatagaccgaaggcaggcggctgcggcatgcgcagacgcggaaccctcccggaatatatcagttatgtagtttaacatactcataaatatcatttgaaacgcaaatccaatgaaaacgccaccgacagaggcgaaaataggtgaattgcccactcgggagatccatcctaaccaaaacatgccgattaccatgctgtcaataatcagttagtgtgtcaaataaaacctaatttgccgccaaacctaccaaggagatgcagcacaggcagtgggtagacggcgataagcgtcgaattgggcccattgcttcccattctgtcttgatttatggtaccaactgctgtacaagaagaaaactggcaatgccaatccggcgccgatgatgactgttggataattagcattatgatgaaacatccgggagtttggtggctgctcacgaggaatataagccaaccctgctatgcttggggacagattatacatgtctgggccgtgttagtaggctcaaaggatgaagttgctgatcagtgtctgaataccttgaaaaatgatcggatacacttggaagataagatacagaattgaatatgcaagagcgagataaatcgacgacatgagcaaaatgggttcgctggctatcaggatagcaggccggaggaatatttttcgggcatcaaacgcctttggttgtgttagtattacctcctctgaatcacagccttccgcaatgcgctgaatagctttctttcgaagaaccggtgcatacgtctctggtaatattgcaaccagtggaattcctggcgccgccatgattgaagcagcccagaatggccatcgccatgagagacgcgacgcaaagcctgatatgagaggcgcggcaaaagcaccccaggtattaagaaccatgaaagccgcaatagattgccctcgcttgtgaggatcatccagaatgtctgagtatagcccgccaacaacagaaaaaggggctgcagcattgacgccggagagaagtctgaatgccaacagagcaggatagttaggtgcacctgaacacgccaacataaatactaagaagccaagatatgacagaatcatcacggggcgacgcccaatgaattcgctcaagggaccaaaaagcaacggtcccaagatgaaaccaaccatattgagcgagttgagtagagcgagttgcattttgctggtcaacgaaaagttctcagatatagcctcgtaggcaccggatgggattgatgtgccaacgctgcagttgaggccacaaaaagatcctgctaccaggacaatcactttcgtcgtctatcaaataacaagattagcatattatagcaacctaagttcttgaagatatgatccaaacctacacgagagaatttcggcttgtcctcattcaaggcatggcaagtggatgcgcgaaccgttgtctcaacaagattttttctttccttatccgatccaacgggaatgccatcttgtgacgaagtatcgatagtttcgaccggcatccttgctattcccttgatattcgacagtcagctaagaagtaacctgggcgactttctcgtcttttgtatttctgtgcacaagcgcccttgctacccattaactccgctttaggtgagcttgtccggtaactgttgatgtgagcaatcgccgctattggctaattagaccgatttcaagacccgcaacttccgaactctaatcccagcgccgcaactggctggaattgccgatccccatcctctgccctctgaagccacttctttctcaactgaactcaactccgacaccgctgtctttctcctttcttgcatgagtatgaatccagtacgagagctagatgctaatcatcttggataaatacacgatgtctacgaactcctcaagtagtcctcaggatgcccccaagagaattagtacacacccaccatatcagctacaaataccatcattcaggagactaacaaagtgtcagacgggcgagcttgtatcaattgccatcaacgcaaggttcgctgtgatatccttgataagggagccccttgcacaaactgctcaactagacaccgcgagggatgttctatttacgtgaaaaaaaggcattgggacagccaagatcggaatagacgacttatgagtattcagcctcgttcacgaaccactgatacgaggcccagcgacaggcttcccggccttcgtccaagaaggcagccactacaaggctcttcagccgaaatatacactgacgagtctcaaacagaggaccccgggaacttcgacgatctcatgaataatgaaagtatccagacaagggaatttggagatcaaaatcgggtttgcttcgtcggaggggccctatccaattgccactatttaatgcggcaaacgtatcctcagcaagttcgccggaacgttttccacttcgggggccggcagtacagttacaaagacacgtctcatgatcttcaacgtattcccacagaagcacttgagaggccgaaaaaggcactggcagacaagctggtccgggcctactttgatcggatcaattgcggatggccaattgtagatgaggagagcttcatgtatcagtatgaaaaaaattactccagtggcccattgcccctgacgctgttgaatgcagtcctcatgatcggggctcacgtgttggcggatcaagatgacgagatgaaagatttgcaaagcatcctgtttcaccgagccaagactctcatcgacttccggctagaccaggaccgcgttgcgttcgtacaggtcgcgattctcatgacttggtactcagatggcttagaagacatcgtggcaaatacgtggcactggattggaatcgccacacggacagccctggggctgggaatgcataggaacacattccagtcgacaatgcagccacattggaaacggatatggacacggctctggtggatcctatttcaatttgatactcttgcatcagcatctctgggaaggccacagattttgtgaggctattcttcacccaacatggataatgaaaggatatgcttgctgatatagtactagaaaccttgatgactccgatgtgcctgagcttgtaccggagcactttaaaggcattcctaacgcaaacatacaatttttgattcagcagtctaaattatgcatgattatttcacgcacagctagagacggctggtctcttcgctctaccgctcaagcccgaagcgacgccatcgagaccacagatgaggcactggccagtttcctccatcaactaccaccagaactccaactgcgagcaaccaacatcacaacatggcaggctatgctccacttaacatacaacaatttcatcattctcattcatcggccgccgccaaaaggcggtctagatggccaagaggacgccagttgcacccggcctcacttgtgcgccgtggctacagtagcgatcagttccattcttgaatctctcattgaccaaaatctgatttgcacattgtggtactctgtcaatcatatcatttttactgcaatcatcaatgcgagcacagaaatcgcctcatcaaacccactaacagcagctgaatcacaacgtatctttcaatcacttcttgcatcattgcggtctttttcaagatactggcgctatgcacaaggtttgttccacatgttccaacagcgagcattgagattgaaatctaggagcatcataacatatgaccagcccatccaccaatcacgccatggcccggaccacttcatagctgtcgactcagaccctgcagctcaacaactactagctgaatatcagactaataacgatcaaatgacaccctgtaccgatttagcctaccaacatgatccgccatgctcggactacacatctcttcctatcactgatgatgagattggatggaacctgctgagtgcggatgaaggtgcccttttagaaaatatattcccatttgattgccctcaagttgatagttttctaaatgaagttttcaaatagattacctctaactatagctttacgctgagataatatatgtgattaatctatttttgatataaaaacgaaaaggtgtagaaatactatctcctaatagtcgctaaacactgatgcaatatcttataaatatttaaatagatactatgtagtctttttcctctatctgcttattatcccaaaggtaggtaatatatactttataaggtatatcatatcttgaaatcttcaagcaatctcagctgtaactagtatctttgtaatgaaaatttaattcgtacttattttaagtaatccatttgagatctgtggctaagttatacattaaactgttcaaactgtctcggcgcatatttcagacagggcaatcatccgatcccagtaaacatcatctactgccctaacttcagcattaggcgtaaactccatatactggttaatgatggagcaatccgatcgtaatggtatgccattaattaaaggtatcagtgaccgtgatagccagtccttagttgccactgcctcatgctgttcatagccaaaccgtatcagataccaccagacacacatgtcaacggagtgcgtctatgtcgattttttttttagcatagagcccactaaaatctctcctttaagacaggaagaatttgtacttaccgcgccgagctcgggagaataaagcttagatacgcactttgcccggaattggcttcgatatcgaaaaatgcgatccaatggcacactggcatctgtaagtgtcttgacgaatgctctaataggagcgcgaacttgtacgtccgaatgattaatccgtaggtctagtcaacttcttgttctatacacgtgccgtagcttgctcttagtttcgagcaaattgctgcagggtagtaattctctagagacgtttgcatcatttgaagagaggaaggagggttaattagggaatacatgtggtgctcgaagaatgttagccgcgtacttttcatgttgccagagatacttgacagacttcgctctccatttcgccgaccattattctcattcctcggtctttgaaaagtctagccacagtgccatctctcagcaacttgagcatgctactactaacaaagttttcatctgtcactggactgaatgtgtctaaacgtaatgacgaaaacttcgcgattagattgctggagggtacattacggagacgatcaattttctcttgcactgacagcgatgaattaatttttaaaaaggagagaacatcttccaattgggttgctacgatatcatcagcttcaaaaaccaattctcatgagatagcaaaactttacatccttgaagtgattttaggttgtacctgaggttcaagatcatcaatgacgttcatagcattgcgttctggcattctcttaccgatattgcattggaacacatgaaaatactacgaaacaacgaatccaatcccattgagcagttcatattgtaactggtagtgagctgacaaggcaccggcgctaagtcctcccagggtgatctgacgcgggtcgcctccaaaagctgatatgtggtctcgcacccattccatggcacaccgctgatcctgtgagtcacagaaaagttggttacccttgtccttcaacgcctaggagtcatgcatctcttacacagaatccaaaattgccctcaattccttgcccagctagaatcccaaaattattgaggcgataacctacctcaattacaatcgctttcagaccagcaccagtcttatcaattaggggtttcccatttgcagccaaccgctgtgcagccagacatacactggctagccatcttctgattgtcgactagaagccggagtccatacatttaacaggagacactcctcagaagcctaaacaagcgtgagccttttgcctgaaaccacgattggaagatgcaggtgacgagtgggacatcttaccgacgcgcctggaacagctgaaaggttcctcccgttcatcatgtaatctggttgtgggcatataggtccaaatttggtacagtcgtaagcgttaccttttctgccatgggaaaaatcagtaggcagggaaatggtcttctgccaacgacgcagcccaacgggtggaagtgcataggatacccctagaaacttggaccgaggtcccgtaccgtacaccgcgtaggcttccatggcccgagatgggaagaatgatatcttagtgcatgggcatctcctcgggcggttgtgttccaaatagttaggaagtcggtacgtggccaacgtagtatcgtatagaggctcaacagtaaatcaagtaacaggaatggggtcaattgtcggagagtggctgaactgagagtttaactctaagcttcttgtcaattattcactcaatgactagtagagagatgccatcgcggatttatccaaagccagtaggctaacttgccatgattggtgtgtcgttgacgtttagattcagagcgttttgagcgtctagagcgccaagggcgttataataggcggcagatctgctctggataagaccaccaagataggtttgatatttgtcctgtaatcatgttacgcctctaattcttgcatggtttaggcctagtctgtgatgatatgagcatgattgatctcattggctatgccttgtgagcatgattaggacgaattctgatgctatactggtcagcgtgtatataacagccatcgatccttgcttcgccgctccattgcaatcggctcgcaaacgacaattgttgggcattgatgcgcagatacaagctttaaccaagagaagacatccctgacatggcagttaaaatttgtcggctccgaatctccgacttgtcctaccgccggatgtaagaccatcattgcttgtgcggctggccaaattgtatgcgttgtcttgtgcgagttctcctagtacggagaaataagttgcgggatgaagtgcatggcgtagccgaagcaacgatgaatacggaagatgccattcttgatctaaccgactttgaggcacgtcacgccctgaatcctaaactacgaagcctagactcactcgaggtcaagaatcggaatttcgatacctatttgaaagcgcatgaagtcttcatcgaagcacgatagctatgtttcctgaccttgtggactgtatggactctattcgttcccttgctacatagtaaaatcttaccactaggtcatgaatcgtgcgaggaataagcaagacgaagttgctaggccgctctacttctgtctagttaaccctttgaacaatacaggagattaaaattgctatcccaacctaaataacctctggctataagacaaataattagtcttaggctgtcttgtttcgtaatgtttccacgttgcattaaaatcgagatcgtgatatgttggttatggtacgaaatcctttcatatttacaggtctgaggaatgtgattcatcgccaagaggaaactagggttaaaccatgcaacaagctcatgcattacttttcattatttgactatcagtcttctagcatagcataacgaaaggcctgtcattgaactagctgctgggatatcagcatgaacctttgcattgatttcgtatactcgactacatgtgcatcgagacatgtcgacagagctcaaacatccccagctacatgcggaacgacagggcctctgttataccgatgatccgaaaatactcgagacctataacgaaggtagacaggctccactggccggttaaactggtgaagatttctattaataggggcaagtggctcagacctgctattcccgtgctcgtctgacagttcgaagtcaaactgagagaccaaataagcatttaccattgacacctcaagcttagcgagtctcatacccagacagatgtgtcgtccactaccccagccgaggtacgagtgaggctgcttcatctcctcagtaacattctcctcgaatcggcgtggattgaaggtcagtggatcgagataaatgtcctcactcaggcccgtgttgtcaaccaaatatgcaacataggcatccggaggaatgacttcttccgtattaccgatggggatgtttttgttagttgtgttcttgcggaaggcggtgccgggctgtcctagtcggatcgattcgcgcaacgagagatctatgaacttgaattccgtttcccactgttcgagactgagtctgtccagcacgtcagctggtgactgagcctcggacgtcctgtattttgcaatgacaccatcaacttcttccttaatacgggctttccattcggagttcgttgcccagtagattggtagataagccgcgtggattgtactgttgataagcccagcaacgagtgccgctatctcgaactatttcaaaactcaacattagtgtggaaacagcagagttgattgtacatcggacggtccaaaaactcactgccacggtatcctgtacactcaaaccatcatccataagtctctgaaaaggatcgtcaacagtcttgcccgatttcttcctatccttgatgatcttgtcaaatatcatgtacatcttgaccccattcagcatttgaatcatgtagtttattgtcggaagccaaggaaagtagatttttgcatggctcgccctgccctcaaactcgctaatcatccgtaaggtagactccagaagcttggggtcctcagcaacctcccgcgctccggtcgcgcgtacagtgagttggtatatcagtctctgcatgaaatcaaatgggttcatcaccccccagtcttggccacgtctggcacatggtgcagcgataagactgtcaaacgctcggcgtgaatcggccttgaagtgatccagcacactgaccaggtttgtggtcttgagcagagttgtgaggatttttgtaaatagttgataaaattcgtttgactcaggggcaggaactccggtcaacaaatcagcatttctagcaggaacagtttgattagcacgcgaatccattggaccctatgtgagaaagaagtcgttaactgcgggccattccatttggtgtctaacctacccctgactgatcgatagttcccggttgtcgaagaaagtcttcttcccttcggaaccacttaatcccacgatgagcttcttgccaacataaaaactaaagttgcctgttttagtcgaccgttgtgcctcgagatacatatctcggcgacgcttatagaagcgccatgcgcccacaataggccaatcattcttggtccattgctttggggcatttgatggtaaaggagtccttgtcaagacttggtggaagagggcactgccaattgccacaaggacagtgcaaatgatggtgcccactatctgcggcctcgcaaggcccgtgattaggtcagacatcaagagatgatgaaagaggatggaaagggaggtttgatatttagtgtcgcggaaaccaccaatgtaggatttaaacccaacaatgagcacgcacgaaggttctgattatgctgcacgaattatggccaaaaatgctgagctaagcataatcgccggactataatttacccgaactctatatatcctaccctgatgcgtcattatttttttacccctttacattcattcttatattaattagtatgaaataaatttatattaatcttaaaattaactggttaaatatgtataaaaaaaaactaaaaagtgtaataaataaattgaggttccaaaaaacttttcatcttagagcctctcgatttggaggataaacgcttacatatctctcagcatgcagtacgggctatacagaagataaaaaacttgttgatgaggggctacatcttataagtgcttgttacctagcgggctttcgaaacatcgtcggaactctgcgcagagtcaatggtcagctttgcgttggcgtagcaaagatgacttacaagtggattgaggatcacaacctgagggatgggtcggttggtgaaggacttcaccatgctaccagaaaactccgagatcagcggatgatcgatggtttaggtttagagcgagcccaacgtgatttggacggacgagaatttcatgatagtctagccagccacaatcataattcgagggagggtagagatatggttggctgtgaggaaggaccaatttattgggctccgtttgtccactttggggtttaggagcagtggtgatgcgtggtatagcaactgatgtaaacacctttcctagtcgctcaagaaggttcgtgacgatgatggggataagggtattgctcttaggtggaatcgaattcagtagcaggaagatgcattacatcaaggcgagaaagggcaccaagccattaggataattagctacacaaggacacaagactgacattaatcatcgaggccatatatgtaagtgcctagatacatcctaccaatgtttctttttgctttcttctttgtttttcagaggatattttcaagccaggcaatgaattatcaactcattcacctttaacaatcgccttttacgaccttttccctttacgaggtgcaatgaaccatcaatcaattgtgcaacgcgtttttcatgggttgttgaacaagcaaagaaaatacggaagtgagacatgttccatttttaaaggcgtataccctggccaattagaggcaaaactgcgagcttgctttattagacgccccgatgagcaggttggcaggcagcgcgtaaaggaaagacgctgagacaggggttcgttgcagctaacgggcctaggttccttcgggtccaagaggcatggaataagctgtcttggcagtcctttccattgccgtgaagatcagcatacataatgtcactgcatggatgtaagacttaagtccccttccaggctgacaccttattatcaggggccgccatacttgcgactgtagccggggtattattcttcttgaaatggggtgaaacagctatttattatttgaggatttacatccacagcgttttggtaagagcttctatcgtaacctatatgtagcatcttaatcaatttgaaatcagttataatgtacataacattatgtctgtaaaattttggttgattgagcggagagagccttttcccaagtaggttacgggggtattcaagtacaaaagttccccaatattgtttatttttatccgttaatgtcggcagtgcaggtgggctttcaattataaaggcacattacattcccctgcccagagccgggcttttcacaatgccttgatagagcccccagactgccaaaaatcgaaacacaaacactcacaattgccactcatcaataggtgggcatgaccaagattcacgatctggccagatgagggacaacagcgtggctcacgacgagtttgggggtggtagagccagcgtcgacgaagcgccaagcaggttatcctctgatttcggaccccaggaagatgttcgccttttaggccttcatcggggtcgctctggggccaaacactctaaaaccgaatccacaattgggggggttgaagctcccaagacctccgcgacttcttaccaatctgcggtccgttttcctccaacgactaagccagcatggcgtccgttttggccgcgagattatattctcgtcctcttttttattctctttctttgctgcacggtagcgcttccttgcatgttactttactcagacagactccgtggcttgggcgaagtcgatagagaatttgtgaggtcgtggagatttggtgcaacagcttgtatggacatccgatgacagtctccaggccgtacatcttgaaatctaacatatacttggaacagttcttacacttgtcgcggcattctggactcgagtggaactacaaatattgcgatatacgccgtgggcatccccacaatcagaccagatcctcaaccaaccggcatcctccttggactacaccgctatgatcgtgcctgtcgcgctcatgcattcgtggaagcagaggcattacctgatcttcatcgtcatcatcgtctctatcatgaccaaactccaagtggtactgtcacctggcctgttctatctggacgacgtgcggtcgacacaggatacggagcttcagatactgacgtcgttcgccgccaacaaaaggtccagtgcaccagctacaggttccaacaattccgccacggctccatggtacaacgcccgggctctctccgcgtttaacatgtcgtatccctttggggtcactaaacaagcagcgtatcaaacattcgaccatcgcgggacaatcgattcgcccatcaccgtcacggtggatgctctgttcatggacattcaatgcattgaatcggaaggatacgaaacccaatgggttgaagaaccgtccaaggctgacacaaagaccacagattataatgtgactttgacggtgcggttcccagactgtgatgagcccgtctccatccaacataattttactttccctgttgacaatgtcactatgtggtctatcgaaccgcagacaaaagccccccacctttgcccgaaactgtcaaagcagtataatcaagttgtgtatctcgcggcgctctacgagagatcggcaaggacggcttcggctgttgagctatcagccctcggtgcagtgatatgcgcacccagcgcctgggtatccaaggtggaaattgtcgatgatggtgccaagccgaacatgaccgtgttgccgaatcaagacaagaatcctatcgacgtaaatctatggaatatccttccgggtgttgttcccgccttcacggggttttgggcacccaatgaatctttaagccgagacctagcctacggtcctgccttggcagaagcctcgtttcgaggtgcagacatgtaccatctagatcgatcggttttccgcagtgacacattgcaccgggttatgacaaacctcacggaaacagttggacccatgattgctcatcaccacttacgagttccggacgacgcacgcatatctggcaatcaggtcgtagtgatgatcaatcaggtcaaggtaaccagggcgatatgtattgccatgacgtgcatattcgccatttcagccgtatttgcattgtacttggcaatctctgtgcgacgcagatttcaaccctggcacagaaacccctctaccgtgttaggagccttgatctttttcaatgcggaccagaggagcgttggggtcgaatatcctaaagccgatagtaaatttgcctggagccattctacattctcgccaatccagttgactacatggcttcgaagcctcttcctcgtctacgctttggcacttgtcattgcgctagccgttactttgagcatatccgagtcctccgacggcttgatcaatgtaaaagaaggtacaccagcactttcgtggatgctggtccctgcagttgcgcttttcatcgtgggtctttatgcctcgtcatccgacacggccgttcgagacagggctatactttctaaactatcatcaagatcatgtacggcacgagaactggatatgtcattgttagacatgcttggtgttcgagccttataccactcgttgacgtccaagatatttgctgttactctaacgcaagtgcttgcgatttgctgcggcgtgttgacgcctttgtcgtcaattcttttcaacgtcaagaatatctctgaggtagaagatgtctcaatcgaacaggacagctggttcggagttcgccgtcagggggccacttcgttcaaggtttgggatacttggcgtatgcaagaggacatgggcagtttgatgttgttccaaaactcgtcagaattgagatatccggaaggaacttatcgcgatttggtataccctattgtcagactcaacgacgctgttcaggattggaccggtagagtatccatctagttaacccttcctgccgccaggttgtccccagagtgtttccaactcaatgatttcaaggcgaatcctgattccgaagtggctgacgaggaccatatcatcgctagctatacagaggagatcatctgtcccaacggccttggtcaagcggcgttaaccagagatatccgcgtcgaattgggaaacgagaccaatcccagatacttcgcgaaaacgatgagctcgcaagattacgcaatgctgattcgaaagctgtgcaaagaggatgacgacgagaataagaactataggccttggactgtggaaacattcatgtggggtgctatttccgcctcgaagaaaacctttgattatatcgagggttggcgatgcaattacacttggaccgaagtccccacactattcacataccgttcttctaatagtcagccgcagctcgactatggcaggccgcccgtttccgatgataccaaagccaagccctgggagccatacttcagcgctcctaacatggactttcttcagcctgacttttccatccagaatgcgcgagcggccgaggtggacgaagctttcgcacctctcatcaagccattcggtccccttgggctggatgagtttggcgactcaagcaagacaaactatattctcaacaccattcacttccgccgagctatagtcgctgcacaatacgccaacgccaacaaccggctgaagttgaatgatacttcaaacacggagcccaaaaatcatccaacgatctcgcctagcaatgaatccatcaccagaaccaacaaacgccggttggtacaaaatttcggagtcaccattgccattatcgtcatcctaacccttgctttcattgtcaatttatgggccctaagctctagaatgatgaaacgatttctcggagttgactcaggcttccttctcgacctcaacatgaagggggtttgcccggatgaattcaacagcctcgtttcatggcacaatcttctctacggcgcggctggatcaaccgtactgccgcgagattcacagtacatgtcctcttcccaaacttgcaaggaactagcggatgtcaatttccaaattggctggttttatctaaataatttgaaggagaaacatttcacaattggaagtttgaatgacccgaactccgaatacatggggagatatgaaagatagactattaatgtccgtgagagtacatggctgccggggctggaagattgctcactatcatggccagtctcccttgaatctccagatagttctcacgatcacctctatgcttagctagaaataacgcaggggagtcacgaagcataaatcacgatttgacccaggccatcaccgctccttggtctactttcaaatggctgttcacactattaacataccacaaaatcaatttgggctatatttccctgcctataaaagaaggagtatattacttatcagtcgattattgactagcaagtccaggccaactaatcaaagcttgaacagggcgatcattgactcttgggtctggcccaacggccactgtaaagtttcagaccatgcagggtctacttcctactggattgcgtaaatgcaatgatagctccaggaatcaatgaaccaacggtgagaccataggacagaaacagcggcaaagtatgccagcacaattagggcaggtgcatgttatgcctgtacagacgccatgtattcggcggggatgagcgccacccacttccagacaagacccatctcaagcggacgattgttattgagacatggggtgaggtctcggatgtatccttccaataacttcaatgcttcgatagagggcgaaatatccacctgtggatgcctttaagcaaagccgtatcgtacattcttaaccttctccaactggacctttagtaaaagaggaagggtaactgccctgttctcttggaagacttggcgaacgacagcctgcacaggtccccaggtgatggattccgagtctggcgtgaataagtcgcgcatgccacggactaataccatcagttgagcaatgctctcaagaggcatgatgcaccggaacctgtcatgtttcggccgacatgccttgcagcattgttgcttgagtcagaatagggatcaaggacgcaacagcaaaagcgacagaagaggctctggtcgttatggatggcaagctctggcggaacattcgtaaagcggtaacctggtgggtcttagagatgccgatcagggaatcagactcagttggtcggaggtgagccaggtgagtagcagctagagccaacagctgatgcattagaaaattatgtctcataggctctagagggccccaatcttgccaaaaccgctggacactctggtcttctgatagagtcaaagacgtatgaagactgtagtgatgcatcaaatacaattcgatgcgccatttctccgagcagctgttgatcgcagagcagggtgtgatattgtaacacatctgggagaagctgcaaacttccatccttcggacgaagttacgacatggtgagttttggtcacactacgaaaagaaacgccacgctgtgtcagtgtcaaagaaacaccatggttggccgagcaagacacaagtgaatgagtaaactcagggaggaggggaaacccacttcgacgcgtcgctgtttacatctgtcgcaacccaacggcgatttcttgtggtgagctagaggcatagacacagaattagaacccgaatgactgattcgtatgcccaactcaaagttgcaactatattcgggaaatctcacattgggagcaagaaatacaaggtaggtaagcgacgattgaataatttcatactgtatagagtgctagctgatgaaatatgctgataatgtgctaatccaaggctatactaaaattgagatagatactgccgggaactgtggaaacccctctgccgtcatgcatatgaatacaggtcacaggaccagagactggatgtcaacagcggttggttagtgaggtctgggtgtacatttcccggaccactcctccccagagcagcctcctaagtagcggattagtgccactctgccgggccaatcgcctcaccggggttggctgttagccatctgcagtcttgaaagtcacacgtctccatatacttggttgtcccccaccactgtgggaactgcgttaggctgttagcaaaattaccattacagggcgcgtgaggatataacttatataacttactgaaatcccctgattcgcaagccccgcaaattgaatgatgatagaaaaggcgataccagacagaagagccgtggacgtgatgtagttgtacttgttccaccactctacatatcggtgtttgatccaatacccaaatacgaaggacactggcaagccttgccataccatagaaaagttgaggggtgcccacaaaatgggaccaaccactatgtcattgagtaagtttatgagtccaactcaaggaaaggttcgtgagggggcactcacagagaacaagaggatggcaaagtcgtaagaagctgttgggccagcgttttcgagccaggtaccaggcaacaggccatagagcgccggcaagggtagcccaagggagctttctatagagggcatcacttccaaagagccttgaggggccgagagctccccagacaatggatgtggtccagctttgagccacattgccacagatccacctgggttgcagcttcgggttacagattctaggaatgccagtaagttggaagttgatgatcccaagctaggtaatcaccgagactacggtagcaaccaattgagaagctaccatgagccttggtggaatcttattatagtggccaagcttcatgtcggacaagaagtacgtggcttgacgcagaacacactttcctaaggacttgaagacgaagatactgatagggtcaccaggaaccgcatagccacctatctatagtgatggcacgaggttaatcttatgagcgaatagccggtaaggagtgacctacaatgctgaagagaaaatctaggtcggtggagtagcccgtcacaccaacgaggaggccaacagggatcacaaatagaccactgaatacaaacgccagtgggtaaacccctatggtatgatgttaggattgtaaagtatcacggggacgggtgagccagaggtcttacaccatggcacgccgacgggccaagcatatacaccagcgatgccaagagccattgcgacaattgcgatgccgccgtacacgtactatcatcacaagtcagttttgttaccaattgaaatatccagccgatgtagtcatcgggacaatgcacgggactcacatacggaacctctttgtaacggctcattaggcggcagtgaacatcacttttccacatagcaagcggatcgctcttgaaccaacttttgaagattggcgcgaataatttcctgtgccaaagatacacaaagattggcatggccggaagcaaggccatcatcccagcccatctcaaaacgaaagctgcgggcaggagtagcggcgaatactcttcgtaagcagtctggttgaacttatagtccttacccagaatgagctgggcctgatatggggccccagtgttgtcatatggcagccaggaattgatgggtagatagccggtgtcccagatattcgagaagaagacagggataattacacatagaccccaaaaagcggtcgagccaaccatctgcaccacaatgaagaatggggtaacaaatggatcgactgtcgagaaccactggtagtcaaaactgctaagagggttgaagcccaagttgaagtagtaggacccggtcaccaaggctaccacggcactcgtaggcttgatccaagtgatccagttgaagaaggttagagtgggaaacattgtattcggaatccaatagtaactgactcgttcggttagtactggcctggatgttcgtgtcggattagggcacataccaccaggcgcgcatgcaaaaacaatgaggaagtacttcatcatagagattctccagccgttggcgattggatttgcaccctgaatgaaagccttattcatggcagtctgccccagtacaaaataccagagtgtgtttggaggaccaaccaagaatcttctacagaaaccggcgagtccgaaccctaggaactaggatgacagtagaatacacaagccatagccctaccacgattaattagaactatttaggctttgatattttagacatatttaggcatgcttacgaagttcgatgcccattccagaccaaggtacgtttcgagcctttgaataaagaacagctcagtcatgataggggccacttcaatgacaattagagaagagtacgtattcatccttagaggaatactcactatagctgacgtttgacataatagtgatgagggtttgctctttcatgctccagggaccaggattcagagtgaaagcaaagcgcgagccttggaagaagattgtcgaggggagaaaagttgtcgccgcctttcccatcgcaaatccaaatagctgggcaaggtatacagcgacggtaatggttggttgccgcggataaaagaactgattgagagcagataggccgccggcccatacaagtcctaataaggggagtagctggttagaagtgatgtctttcgccggtagcgcaaccaacataccgatcacccacatccgaatagtgttggcaggctcctcgacattgtcactcgggggcacgatggctcgaacttcctggtacaccgagttgctgtgaataacggcggcaacacatcgcgcgattgccaggtcgtgcaaatcggtttctttggaagcttcgatcctttcgagaaacatgttgactgtggccaccgagtgtgttggcacacacatgtcgtcccttaggacccccaagttagtagcgcgcttcctgagaggctatagtattattatcagaacatacccatgaattttcaggaagtctctcagaatctcctctacctgctcgggggacaaagatgaggcgaattcgctggccgcctcaatatcgtccgagctgatgcccattgcaatataaactttcctggcatcctcatcatttggcgcgataaatgtctgcgctcatctcagttaggctcggcacttccatttataactctagagtcaaaagttccggggctctcacgtacgtctatcatatctggtctgtgatggtcgatagattgtgcttccactgtagatagctttatatcccccatcttagcgagtgcaagaattgatgggttgagatcaatgatcgcaaaggaaccaagactcgaagcgttgaaccgacatatctaatactttcgagagattggacgttactatactcaaatgtacgtggatggcatcaagcgcctgccgctaaataatcccggatgaggcatattagagcgcgcaggcgtgggtggttgcttatcagcgacttagggcctggagtctcggccctagagattatatctgtacaaaggcgctactaaggcttagtattccgtttatttcttagtaggcttaggtccaaaggcctagtctcaagttggggagctggtcatacgactaagggtgttagattaagactagcattggggaaagttcagtagcaaagcaggggccgttggtgatggataatgatttccagatactggtccatgcgacaagcaacaccaaacacaagagtccacccaacaggtacttaatagatcgcaatcatatacggcctatatagtgataactttaattcactatgctgatcaacggtagacagaattagacttatggcatacatataatatcctctactaagtcttcagtgactaattaataaggagatctaaactcttgataaatttgttagtaactcgtttatatgttgttcgcgagcttcctatacctctgtagtgtttcctcaggtcctcaattcaaccacaccaatgcacgtcttgcctcgatgttcaatcttaattactgttccaaattgaatggacaccttcctcagatgctctaggatgcgctgtgcctcgttaacgggcgcaattttcggcattgcgtcgctttttaatttcgtttcactatctgatagctggctgtgaatcgtgggttgcagcgttatgctggatagtgcacccgctgtaaaggtgatggaggcaatgataccatcgtcccattcaattgggagctcataccctcggaaacttcgccccagactataggtcaggtgccctacaccgtagaatataggccgtccctcgtagatctcaatgccacggagatgatgtggtccatggactaggacggcgctggcaccagcatcgacagcggccttgctggtggtcaccacgtaagaagccggaacggttgagactgggggcagcggcaccgaggcatcagccgccccggactcagactcgtgggcatggaaggagaagatgactccatcggatttggccttagcctctcgtatagaagctgtcacccggtcgaggtcagattggtttatgtcccagaaaagcctcggagagtctatggtctgatcgcaacgccattgtgaccaaaaaagaggatgctgtcccgtgtgtaaagtgatatcggtaacgagttctgcgagactctggccttgagcgacagcaatattccgaatggcagaaaagtccctttcgttcaacaccgttacgggcttggctcggataacattcacacctggtcgaggctggaggaaggctgcttcatcaccaggcccagcaaccgactgcggtgtgtgggatccagccgcacatacaagtgctagatgaacgccgtttctgtcagcgtatgttgcctgttgggcttcggcaagcgacaggccgcaaccagcggagtgtatactggcgtcacgaagattcttgcgcgttgtcatcattcccaacacctcgtagtcccatgcgtgattattggcgagagaagcaaggttgaagcctgcggaagccaaaagatgggcctgatcagggttgtaggtcggtccccagccgacacctccccagccattgtcggctccattctcagatgctggatatccatcgaactcggcgtcacggaagacttggccttccatgttgaagaaggcgtggtctgcggaacgcaccaagtcccagagttcgagggtgtcggtgtctacactgtcgatgaagccccccaagagatccccggtcgcggcgatcgaccatgactttggaccatgcgaggaggagcccgattgcaaatcaggctgggaacaggaaatcggcatcatgcgaaaaaattgattcccggatcggctccgggtggtctttgctgggttgacgtgagaccccagggtatcatcataagcaggacggaagacaacgatgaacgcagtaccatgacccttggagagctataatcgaaagtttgcctagagtgaacttgattactagccagctattctgctgccttcgaaagcatcaatggtgtagggcggcaaagatgtcccagtcgggtagtccggagcgccttcattccccacaatcggcaacgacatgcgcgacattcccacgaccctcgacctctgagaaattcgagacgtagttctgagaggagcttcgcggcaagatggcagaccgggcgaaagaacatgaagccagtctaacgatgatccactgggggcgttcctgattcccaatactggaaagttgggttgtaaagccgcgcaaaagcctgtgagtccctaatgctatccgctctcataagaagccagctaaatctcatcctgccaatatcgcgagagagttgagcatatgcgcgattcctcacccgccaagaaactctcctgtggctgactaccattcagcactatgacccagcttcccctgcatcatgcgctggatcaggcagacttggctgtcaccattacgcccggcctcctgcacgagacagtcacccatttgattgtccaagtcgtgttgaaaaagcctgccctgggccctggtgatatcccggtgcagctgcctcttgagctagctaagattcccacggctaggtatgacggcaacaccctcaaagcctttgatcagtctggcccgcttgagttggaaaggtctgacgacccggaaggcccgccaatcatttggcggaaatggatcactacgaggccgacgcatggcgatgtgaccattttggcgacacctttgcccagggttgttggggtcgacaccaagactggcccggcctttgacttacgcgctgacaacaacggcatcattggcactggctacgccttccttcccctccctgcagatggcgagagcaagctcactatctctgttgattttgacttgcgctactctccagcagggttccatggtgtcttcacccactctccaccagatctatccacagcgcggttgaccgggaggccatcgatcctccaccaatcgttctacctgctagggcgccttaaatacttgaaggactacggaaacaatcatgaagcagtgacctcttccgagtcaggacactttaacatattctggcaaagtgaactgccattcgacatccagaaggtggcgaaagagacgaagcaggttttcgaatatatgtgtgactttttccagtgttctggagagtcatatcgcatcttctttcgagaagacccgtactacgttgtccgcagcggcctcgcccagcccggagccttcctcatctcctttggcctcttgctgaagcaagctggctgggccctcgactctttcaccacactattcgctcacgaaatgacgcacaactttgcgaatcttgccgagggagaggatattgccaatggtgcgcagtggtatgccgagggtttggcagagtattgctccatctttgcacgctaccgactgggcttgctcgataagcacggtgtcatcaacgagatgaactaccgagcccaagcgtactacactagtcccttagcaacattatcgaacgaagaggtgaacaagcttacgtggaagacgcaaaacgcccagcgcttgccgtactcgcggggcctcgtcttttggattcgcctggatgcgctcatccgcgaaacttctggtgggcatcacggcattgacaagttggttgtggagatggtgcagcttgccaggacgcgtggaaagcttccaacccttgccgaattccttgaacggctagcccaggacctcggtcctgtagctcgccaggaatatgagcaccataactctggcaagctgattgttccccctgagcacagcctgatacctggagctgttgccgtccgtattgacatggaacctttcgaccttggctttaacgaggagagtgtgttactgggacctagaatcgtgagaggtctgcgatcggactcgagggctgcaaaggctggcatcctggagggagatctcatcacgtcttggatagatctaaatcactgcaaagatcacctcgaggtcaagatggaactgaaaatagaaagaaaaactgcagattcagaggtacctcgggagctcgacatcacgttctggcccagggcatacacaaaggtcgagggctggggttggaagctggttaatgcaaaggattgaattcctagcatttattcaaaatataattcaaagctcaagcaacagggccgctccattccagtaacactggaaagatgacatatcatgcatggtgtcacaaaagtggcagtaaaaagctcctttggccgatggagcgtcattaggagcctggtgccgaaagttcttcagacatacactgcagacccgttcaccaccgtctcaggctgagtagccatacattcgtgtgttctcgctggctatgaatttatcctccgtaatcccaatccattttatctcctgcaacagagatggaatcatttaagcccaacaacgtggaagttgaagaaaccgtcctggttggtctccacgacatcgactgaactgacagcagtcaagatgctgttgccatccttgacaagctccacactctgcttgccaaccttgacgccagtggcagaaccgtagttcaggccaggctgcgcggctgtctcgcggatcacctcgccgccactggtcacgcggatagagagacccgaggcgtcagccccaacgacgatgccgtaattaacggcgtcgatggcggactgccagttgtcgggcttctggcaggaagcatctttgagaataggcctgtaccacatagcaccgacagcctcggagcccccgggaggggtcatgccggatgcatcacgaccatctttgtaggcagaaatgaaggaggcgataagaggctgccagtcgtagtgaggccaaacatcagtgttggagtaggctaggatttcctcggttaagccctcgggccagttgttgccaatgtagtggctctcaccggcatcgttctttcatctggtaagtggctggccggcatgatggggaactgggaaccgtaaacttacccatgttaggacctcgacaaagtcggggttcagagctaagagctgtgacatgcgttgagggaggttagcctctccgatacggtaatagctaccgccgcagcacttcttgaactgcagagaagaaagagctagatagatggcgtgagccttttattgctttaaacgtgagccaggtacttacgggccatgtaggtctttccggcagcatgggcggcgttttgcacggccgtgtccacggcatcgctgacgttggcaggtgtctgacccggtgcgggccacgcagactcccagccaaacacgccgtcgacaacgttgccccactgcccaaaccacgtctcggggttgtcgtagcccgaggatgtgtcggcattggggagaaagtagaccttgccgttgtaattgttctgtatccaagtctggaagtcctgggggctgaggccgccgacgctaaaagtgctgatcacgggcagattatccggtccggccttgaggtaggactcgcggttgatgtaattgctgacgagctcggtgtacgcattgacatcgccagtctggtaaaagtcgagactaaagaagagctggaagccggtctggtcggccttgtcaaacagctgcttgactgtggactgcgcccaggactgacctggttggccgacattcatggcgaaggcctcgatgccgagagcttgtgcctggtcgatgtcgagttccgcatggccgctaccttcagtgacggttccaatctggagtatatcgtcagacttctgcaattgtgtattcagcattattccagcgtccttaccatatagtgggcatagacagacttggcgtcaaccgcatggcacgtcagcaagacgatgctagcaagagccttggctacataagggctgatcttgaccattgtcgccagtggggtgggagtcctcgaataagtgaaaaagatgcttatgatgaggatcacaactcgggtctttttttcgcaggaacatacgaagagaacccgtttatataactattcggtcttgcttcatgtcatccgagcggttagtgacatcgttgagcgcatgtctgtaatagtccccagcactctgaaacacccgaatatagaaaccaccaaccatacgattggcagcattctgtccccatctgtacatgacccaaaagcctcttacacgcataagtaataccttcccgatggggaaaggagctacggtggtcgaaatctgccgaaccactgaagaatcatcagcctgttcaaccctgggacaacccgcaatcgaagacgcggtagtacgtaaggcaatcatatctgccgaaccgcgcgcaacggccatctcccgattgaggccaaaggatcacgagcttgcgaccgggccgatttggttggcccaatccttcatcccctcccacttggctcggcattcgaaaataacttcattacaatccgccgagtaaggcaagttttatttggacacctcgccctactcaaacagactcaaacgtcaggcctccaattcgcctgcatgtttccgccccatgtgtacatgaggtaggcatcacccatacgtgacttggaccctcttggatcctttggtgcaggcatatattagtcaactttcggctgattctcaatcgagtgcaataattacgactaattcagcactactatccttggtataacccatagtgtaccgccctcaggcttgataaacaatgggttggacaggaaaagagaatgtcagagtaatacacagtagatatccttcagctaggctaggggatttcccttgcagccttgtgtattactccaccatagagagcaattgaactcagagcccggtacaactcacctcttgttacaactgtttgctcagagtgacaagaaaaacacaggtggaatagtagcttgtttctatacaatgtgtaatgtatcaatgcgcgccatattatccgcaacagccaccgccgcctctccatgcattaggccttcgacataacacggccctaaattgatgttgtaaccattcatctctcgcaagagcaaaggtaccgggcaccctgccaagacgcaaacacaatcaccatcctgcaagcccttgcggccccagccgatgtatcccttgcgtgtcacgaacgccgcatgatcccgcattccactagagacgccatttcgatagttcatgctgtccggaactaaagggtcaaagttcctatcggactccagactccgcgtcagctcctgcgtcctgctggtcagacgcggaagggccccgacgagttgttgagcaacagcgctcaaaggacgcccaataaacttctccgcgataccatcaggggtagatataccaagcttttcctcggcctgtttgatttctgccgcagcactggtattgttaccagtgtagaatgttgccagcatggctgggatcactgagagaagggtggtctcaacatctgatgcacgttcaaggatttcattgctcgcaaacttccggccacgaagaacgagacgcgcgagtgcctggagagctgggatgccgtctgggtacggttggccaccacgtgcgttcatgtattcgaggcagaatgacagccaactcccgtctccaacgtcacaaagctcaatctgagagacagtgtcaaaggatattccctgcgaaatgagaaacttgccgtctatcaaccagggaacattcccattgatgggaacatgaatggacgtccagcctttatctgcctggtccgttgcgctcagtagccaggtgaagttgtacattttggaaatttgatcccagttagggacccaagacggaacaaacaagtgcatcggcagtgttttgttgtcaacatctgttggtggcagctcccaatgcccagcgtaagagagtatgccgaggctttcctccacctcaatgcttgtggttgcaaattcgtagaagactgtttccacagaggcagagtagttgggctgcagtaacccaataccaacaagtcctagtacactgtagagatgatcccggggatccgtggcctgttggtcgacggtggaaaggatccatgccttccactgtaaatgctgctccttcctggatgctgcatcctggtccccctttgtttcttccgacggcgtaactcttcgacgctgaacaaacctattccagcccatcgagtaccaacccaccttggtcgacaaaagtcgccaaagctcaacgctgaccaaaggagggcagggtctgccttggatgcgacggagccagtagtagacagcattgagctggtggtagtgtatgatattcttgccgcagaagactatgacgttattctgtaaaagaatctcctgtacgatccatgccctcctccagtacgaacgcttcatgatagcacctgcacttgtccagaaccgatttagaaatccaccgccctcggcttggtccgactgccacagctcgggctgctcatcgggcttgacccaggccatgtcgtctgtcttcatcgtctgaagaatcttgctgccgatttctgcaaggatgggcatggcatagtcgctatcattctcatcctcgcctagatatgtaaacgtggcctgcgcacggctgtaaatggctcccatgagcccaacctggacggtcctctcatccacattactctggtcaatgcacagcgcgtcgatccatatcgggagctgaaacatttccgagttgggcacagcctgggcgatgttgcggaaccgggtcaacagagcggccaaattccgcgtcacctcgatgcagtgaccattgaccatgacagcctcgtcaatctcggggacgtccacgctgtagttccactcgtacgagaaggcgttgtaccttggtcggggctggtgtgccagtgacacagtgaacatcgcgcaatggcagatggagaagacatcatcggcatcatacgacgcgatacgcaaaagacggatctctgtgtgcttgacgctgaggggggcatagagttgactctccgtagctgggggtatggtcataggcgtcatttcgcggtggacagtggtggtgtgaactgaatctgagattcgcacaaatgtgcgtgcgtttgccctgcgaaatgctccctcttcgcattcttcgcattcagttcagttgaccggtcccaccagccccccaagttatcggacctatgaggagatggaaagtggagttttgcgattgccaagttatgcgagcatttcgcaaaactcaggtgcgtgcccaatgttaggcgtgagtatcgtgcttacgtacattttcatattacttgcgaaacatttatttaaggagaggcaagccgatgaggttaggtttcattcacctcttaaatgatgaaacacactcaaagaatttatcgccaccgcctgttatccatcacgtccaagcaagcccatcatacgcgtctactcttcacttttctctcgacttaaatctagcagaaacattattggcctctgcgacatatctactaaagtaatctcgacagtttagcagcatgctcctcgaaagcagctctcaccctcttggtgccatcttgtccagctcggtccttttctccgttgtcctcttccatagtcttctcattggtgttaccttactccttgcttataagcattctggtctatgtacatcgtggagacatggaactcatcaccatagatccaatgcctggcagttgcttctcaagttacctcttgtgtgccgaatcttgcgcttgtccccgacaggcacgatctcctgcgcagatcatcacatgtgtcgatcatattctcaacaaccttcccaagaggcgggaaccagctctgttcggccaactgtttttaatcatggtacaacccaccctatcagtaagggaaagggcgacgaggatccatctgagtctgctgtaagtgcttatgcccaagattcaccatcatcaagtgccttcctagcctgtcctttttacaaactcgaccctgccagatatccgaggtgcgtagggaaatacgaactgcgccggttttccgacgttaaacagcacctcattcgtgctcacactctgtgtgagtatcattgcactcgttgttggaccgagtttgacaatttcgattcctatcgcagtcacacaagcagaagcagctgccaggaagaaccaggacctgaacctttgcttccggtggaagttcaaaggctacgtgaggacacgagggggacctctaaggcgcaaaaatggtactggctatgggacaacctatttagggggcatgagccaccgccatcaccttttttggacccagaggatgaagttgcccgccgctacgtattgataggtgacagcgtcgaacattcaattgcagacaggctatcatcttggttgtcccccagccagcaccggcaaatgtatagaactgtcttaagtgatatattgactgctcttggcttttcgccaaagcggtacaggcgcttcccaagttactacaacgtactatcgaccaatactcctccctcttatgagttacccttgcattcaaccgcgattgatgccttgccatccttcagaccctcctcaatcgatgaggtccgacacgcttgtcaatggtcttttccacctggccggatgagagcggcaggtgaatccagatcgggatcacctgaatccacgcatccgacttctgtggaagaacccatcacacctgagagcacagactactacgcgtcaagtgatgacgagggatcacaatctagtacagcgaccgagaacgatgactcaactgccagctctccacaagattatcacctttcttcgctccttcgggaacaaaacatggagagctttatgataaagactgttggtgatttggtccttcgttgggtgagacagtgccctcctgatcataaccctggtcagagcaccccgagcccctcctggaatataaatgctgctggtactggtcaacctactggagggtccggaccaagccaaattggccgaaagcgagggttgggcgggaatgaggaaggggaagatggtgaccgaaacaaacggcaaaagtccatcaatgacgatgttgcagaagacggtccaaggcgtctttttgcctgcccctatcgccaacagtatcccgaaaaagcgtggccaaaatgcgaacagggctggccatcccctcgtcgagtcaagtattcccgatgccaatcagaccggtttccaagtttccgaggcgatgctaatagttgatactagggatcacgtctatagggagcacgaactcgttcttcattgtgacagatgctacgctgagttcgaaacggagaccgagttaactgaacatcgccgaaccgatccgccatgtcctcttacggaacacaccgcagatggacttaagcttggctacacagacgccatgaagttacagttgaagtcaaggagaggtgtgcagaaactgtcaccagaacaacgatggaggaggatgcaccaaattctatttcccaatgctcaggagataccttcatgttgtaagacgcatacgaaattgatttagaataaaatcaagtgctaaccttaggcagactacaagccagcagttcaaatgcatcctgttttccaggagcaaattgatggcgtgatccagcagatcacccaaaaccttgtgaacaatcccgagctacaggctcatccccagctgtcagaagagagagtatcaaatgtagttcaccaagcagtctggcagtttctgggttcagtgttacccaatattgctccacagcatgcagggaaagggaaggatgcctacagcccaagtgcggcgcccggaagccctttacctatgcctcagcatcatggcatccagactctgggtccacagccttgcagcgacaacgcaatagaccccgaaacatccgtcactcgcgatcatgaccctatttcttctgaatgcaatttttctcggtcaacctactcccatcctcgcggcaacagttttgagggtttccagttccaaggcgatggttcagctcccgctgccaccctatcattagaggatctcaacttacccctacttgatcccaaagaattcgatttggagtcgttcgtaaacgcatcgttcaacttttaacattataagctttatgaggtatgtgttttatacgctgaccatgaatttatgacaagcggactaaacatcccagcagcaatcgataggctggaagatgtcagataattggttgtatgtacgcgttctccgtggctgacgcctgcattctcggctggcctaggcccctgagatatgcaaatggcgggaagtcactttcctaggttttactgactagccggaattcttccgtcttctgacagaagagctcaccgatttcagtgtatcgtgcgctaccttctcatcgatattacactatcttttattttccctcgcttttctgattatctctctctccttattcctctggggtttttttttttttttttttttggtgatatttacgtcaagtagctatttacttacagttgaaagaggaggcacaccgctccaagatgcccatttttatatacctacttgatagtattagctactacctaagtagggtcacgctaaaattagtaggtattttatccgagaaagtagcaggtggctagcaatccccttaaagtaacccacgacttttttaccactattgctgcgccatggatccaagtcaacgtgtaattagacctggagcactgcttgtatttgtcctaaatcggctatggcactacccatcgcgtacatctccaccgatcgcgcccgtacagcatcaaaggatgtacctgaagtagggttgctcaaaatcagtaaggtccagaaacttagccctctcagcctcctcagttatgttggtggttccgctctccgcctgtagccgatcccgtctcttattctcgagcacattcacaagtcgaattaggagcagaaccactgcagaacaccgtacatgatcgccaccatcatcttcccgctcctgtactcgggagcctcattactgcggaaggtctgtggcccaatccagttgccggctccataggcgaggatctggagaccattaacagtagccttcttggtataacccagggtgttattagaaattatcaccataacaagcccccaggcggatccagagacgctgatcatgtaatatccaatcagcagaccggccttggcggtctgcggaaggacaatcatgaggattccgccgaccatagggaagagaatggcgataaaggccatcaagctgcgcgactgatacttatccggtagccaagtaagaatcagcttgccaccagtatcaatgatacctgaaggagcaccaagaacgagggataatctgctgttgaagccaaaagaactgatagtcaactgttagtcagggcaccaaatgtggtgataccaccgttagggatgttcatcagcagcgagaaaagaacatagacatacgtcctagggtccttgaatgcttctcggaactggtaccatttccaaacacggtctcacatttcctggaagttgtccttgaggcgctggccagcaatagctttctgtctaggcgaaagaaaccacgcgttaaggagagagtccggcatgtagaagcagcaaaccaccccagtagctaccgttagaagacctaaaataaggaacaagatcttccacgaggcgacagcggcatctgttatcgctgatagcccgtatccaactccggccatgacaataagcgttatgccattacagctaagccagtaaccggttcgtcgaccctgttcagtcttgcgataccacatagatgttatgataacaaaggatggtgttactgttgcctcgaacacacccaggaggaagcggactgtaaaaaggccagcataatcagaggcaacagcatggagagtaaggataatgccacagagaacaatgttggccaaggtgtatttgccaataggcagtcgacggaggaggtatgtcgtcggaaatctgttgtcgttaatatctgtcattaagttatgtattggtgctgggatggcagccgtactcccacagaatgtatccagcataaaagatgctagacacccagctatattgctgcgactttgggtcgaggcgggtgtcgtcgcggatccccatgagtgaggcgtaattaagactaatcttgtcggcgaactggatagcgtacacccagcacataagcggcatgatgtgccaatcgattttggagagaaccgtcttctcttcttcgggagtaaaatcaaggacctcgccaccagtcacagccaaggcagggtcgatgtcacgagacatcactggcttctctgtcatggagcccgagcgattgctcagcgagggtccaatctctggcatgtcgactcccgtggcctttgcagacatgatgtcaacaggcaacaagaacggaacaagatgtctggcaaggggtgagtagacgactaagaagagtgagtgagtgctgtggtgctggccttggtgtcggctcgagaattgctttcgtgtatcttctttataggtacttcggaagctaagcggatgacatctcatatctgcatgagatagcatacccagggcccatccccagattgtggtggaccagagagcgtcatgcatcatcctcgataacattcacgagcgcaagcttgcaatgtggccattctttgcagcctgaatcgtgttaacgttatctggcggagctccacaagctactccctccactgctatctctctaccccttactttcttctcccgatggagctccaccactagatcatctctgtgaaacgccaggttgggtagagggggtcttgtgtggagggagttgcctcttgtgggggagatgctgctcatgggcacatcaaattgacgagcattataagtacgaaataatctccatgactagtagacataccccggattacgccaattgcaagagtctagacccttcgtccataacaagatgaccaatactactcttcccccgatccccaagtggatcccagctccagcgacaaaggagaaccgttagtagtattcgcagacagaatatgactattgctgactgaattgatatcagtggactacattgaactgtccaacttagacttgtcggatttcgataaccctgagtcaaggaaaaaagttgcgtggcagttctacgaggctttcacgcaggagggattcgtcactgtctctggccatggcatctcgaaacagacctgggaccagcagattgacctctgcaagtcaatctctactctacccctgcactacgtagtcggaactcacagtttcaagatcgacttttacaacatgctctatcaagacagtaaagcagacagaaagcaccctcctcacctagttccgtaccttgatgaaatccgggaggtcatgctccgcgtccgcgatgatatccagaagaagttattcatcctgctagctatgtgtctcgagatgcccgttgatgaactcatagctacgcatgcgcctggacagtcgagctcagagtgttaccgttacgtatgtgaagcaaaccttgaatgaagaaagaagctcatagctatcagatgagctacgcacctttaactccagaagctacggccaaggcgcgtggtcttttcatgccggcacacgcggcctagggtacctttttcatcctcttttcgcaaccagtgtctgccttacaaatcctgcacaagtccggcgtcttcaagtgggttgaggtgtgtatcataagtcgcggcagatctagtgactagtctttgtttctaaccccacgatagtataggccttacactctcatcgttaacgttggtcaagcactagagctgctcacgggcgggctcttcccagcgacaatccatagggtcgtcacgcctcccaaggaccaagttgactgtttgcgagttggcatttactacttctcacgcccgaatgacgacttccctctggctccgttccacaactctcctttactcaaaagagtgggcaaggataagccgctaggcccagatgtcacatatagtacggtcgagtttctcgaggctaagaagcatgggtacctcaaaccagacctagattttgacaatccaaaagacaaggaccttcacgatgatccgttcaggcagggcgataggttcgcagcgacagagaaggtgcttgcttctatcaccaaagtctcggcttagtattgtctagatagaagatatctgcttgaagtacagtacttctcaattcatcaatccgtgatgacaccaaagcgattgagtaaatgcctaagttggattaagggaaacaggccttgcagggcgctcaacgccgcatctccagtgatgccaagcgatttgcatctcgacaaacctttgcatggcggcccatgcttccggctcatttgtagttacagaagcctaacgaaatcttgtctgggagcaatatgtatcgtctacaagattttcaaactttacttgtctaccttctttcttagtgatatcagtcgttgccttcctactattttcgctccataaaggaagcccagcatccatcctcgctatgccatgataaaatggaaataggtagcactttcacgttttagcatttttttacccctgagctatagactattcattgagtagtggaaacacgatggccacaagcccctatacacgagcagggatgtctaatcgaatgacgatagaattctgtgttcgcttcacgactttctagaactctatacacctaccctctttactgtggtttctgatgctcggaaattaaaagcagttaagtccagcgagcgtgtttttaacggatcgcaacttcagctcaagtcatcgaagataaatccatagaatcctggatgagttcaatatgagcatcattatgttttagtactccaatgattctttgaaacttcaatttattaaacaagtcctctcctcatttgttaactcatttgtgacaagtaccctctaccaggtatactagttggctctcactaattgtcctagtttctcaaagaaactttggcccttggtatcattgcaagagtctatccacagaaagtctttcagatattctcgcacttccatccattgcaattcttgtataagcggaagcacacccgatcgccacttctcgcgaagacattcttcatccgtgtcaaagaaggcgagcgtaccaaccattagtacccacgacatgactaggcgaagctgttgcgttgacacctcgatggcgcggcacagaactcttaactggttagtggcatggtcgtatcgaatgcgactgttcatgaggctaaacgtcgtagttagaaagctgagcatcgcaacacgcagccattctccgaggatatcagacatcgttccctgcagttgccagagtctatactgcgccacgaagatgccagcatggacctcatactcctgtatcccttcagattgggcgttggtcgccgtattgatgcgccacgccaagtactgtaagtctaggaaaataggaaccagacgtgcatcgaaaatatggataactggttgccatgaacaaagtgacaaacatgcctgcggatggggcttgaccaggtggtgaacaaggccaactgggtcacactgaggaaaataaccctgtccagagctgagtgtcacacatagatcaatcctaaataatataagcccaattcatcaatgtcggatatatatcttaccgagagagcacaactagtatctgcggattaccgcgaaaactttcgaaacctccccgcagatataccattcgccgcaatccatttccatggatacacatagcgagatggtcatttgtcactaaagccgcaagggtcagagcaatgacgttggcaattctggcgtctgatatcgaggtattgtcgctcgagagtctttcgttgagctgagagatggctgttctaatgcaaagcaatgtatgctttgatcgctcagttgccagaaggaattcttgaataactgcgcatacagcaacaatggaatacacgtaggccctatctgacaatagccaatcactccattgggatgattcgaagtgagacggtaagcggaacctggcgaagggaaaggcgctcatggcgccagggaaaactacatccattcagctttcggctgttcaacttcacaaggcgggctgggagaattttaccagtagcgagcagtcccaaggactcgttatcaacttcaacagcaaaatcgaccaagcaggggagggaaagtagcggcgacttcacacgtgttgcggtagaaaattgactaccctcctgctcataaggtggcaacgacgcatttggttttacaacacggcggtctcgaaaaatatcattctcgtacaaccacgcggaaggatttcgtcgattcttgccgcgcatgcagtggctccgaatctttctccgttcagctgtctgtggctttccagaagcctttggtgacacgtttatgaactcaaaatgccgatgcgcccttgccattatgcagctgttgcgatgcaattgtcagagggttaaatgacgttcacagtccatacattgctgggtttccaatcacatgttttgctgctcactgagatcaggggaggggtttgccgcaacacacggtaggatccgcgtacattttgattctattatcagaagttcactctcaggcgcatcatcttcgtaaataccttcgtaattaaagacgtatttcgcagcgattgaagaaaacttatcataggtagcttagcaaacgaatagaagctcgatacaatgagtaatgaacttatcttatagctctaattagtaccttctctaccaataagacatgccgttaattgaggaaccttatatatttgttctgtggctgacctgttgatcaaccgacgcatgtttagggtagcttgattcttgccaaagtcagcaatcctcccgggttcggcatgtggagaatgccttggtctcgcgttttcatttgcttgtcgcgtcagccctcatttccctccgttgtcctctatggatcctcgagccggaatcgccaaatcgttattctagtctaggccgtcaaatgtgtctgggggagtgcaatgtcctctccacgcgtaaagttgtgcccgaacttgaccaaactgtgatctgcatggaccagtcctcacactttgtgctctgacctgcaaacacaccaccaactttcaacctcaacccgtctttcggctgcagcgcgccgcctacgagaataggagactaacattagatatctcccacgaaagagttctcgagtttctgcatctatcgtagccatcatgcggcgctgaaggaatggaagcgtggcatgtgcgcgagcttgaaatctgcagggggtagccggctattgtggccagattggagagactggactggagtgtcagtaacccaagactcatatccctaacagcaagaggcgaccggcgagagaagagatcatgcagtttctcgattctcctcccttggcgcaacgtgtatcccacctgtacgctgaagaagctagcgataactgcgtatgtggcgacgaaggctgtgtcaagatgcttttaatcacgcccctacctcgacctcgggagctgaggcttgccaaaacactttatgatgagcatacaagtctggcgtggttgcgtagagttatctcgagagcgtagaaattggagactggcccgcgggactccagagccttcgaaagccaagctcccaaaggccggcaatctttggtcgttcgtgggctgggtgatatgatatacccgttgagcgacatgcatcaactggttttgagtctgactggaacacggtttcactctctcgaaaattgctattctacaacttgcgcggcctgagcggctttcctctttcaattcacacgccttttttatgtcggccattgtcatcatctccgaaatgcaaacattgagttgaacgatgcggaaatcatcgcatttggacggttgggcatttcttatcattctagaaggctacgatgaaaaatttggactaagctgacaaaccaactctttacatatttgaaggcaatctgtcacttatgacagagaaacaaacctcgaaattccggctgccttggcagccaactgtccaatacgttggccaccgacgatttcaaagacggatacatccgagccaatctcctttgtcatccaagtacgcagttccactgccacgagcgaatcgacgccataagtgtgcataggtcgggcagggtcaagctcagcgagatcgacgcttagaactttggagagcttttctagaagggcgtcgagtacaatctgttcagcctctgactgtgtcttggcagcggagagagcggaagcggccgatccctttccacatccttgcttcccggcgtttcccccatcctcgccgttgtgcaggatcatgtggttgaatcgtggctcgtgctgccactcgggctgactggcgccctctgcagcagagtacttggggagccagagcctgggcacgacttgagcctgcttggcaagtgtttccttgttgtccggaccaacggggcgggagtagtagtcgatggcggcaatgagttcctcggccgacatgtgggaccatccaatgttgaacaagtattccatcagcaacggcttggtggctaccatgccggcgtcgttcatcatgggaacattgagagcgacgacattgtggccctctgcggcgagggttcgggcaaagacgtcctggtatgagttgccggcagcgtagttactctggccagggttgccgatgatggaggccatagaggagagcatgatgaagaaatcgagggtgccgtcctcgtttcttgaggtcagagtatcccacaagttcttggttccagcgaccttaacactgagtgtacgctgccactcgccaaggctcatgtccttgaatgtgttgtcctaagatctatgttaattctacaacttcaggtaatttggagtgaggcaagtgaatagacttacgctgagaatagtggaagcctggatgcatcctcgtacaggtggcatctgcaaaaggcaagaagagataacactctccaaggtgcccttgctggtaatgtcgcaagcaggagtggcaatggtcacgccttggctccgcaattcagcaacaagtgctttggcagattcatcaaccgctcctcttctggatgtgacaaccaagctcttcactccctgtctgaccatccaccgaatgatttcctgtccaagacctccaaacccaccagaaacaacatatgtggcttccgaattgaacctggcagcaggcttgggaggttgaaccacagcaacgacgtcattctcactgggcacaatgacgagctttccaatgtgcttgccggactgcatgtggcgtagggcgtcttgaatctgggaaagggaatacctggtgatgggagtttcacgctttaggccctggctaagaacgctgtccatggcacgcccaaagaggtcctcgattctgtccatgtcggtgttttgcatgtagtttagctcaatggcctcgaatcgagcgccccgggcaaatgtacccatagagatgcgagcccttgactcaatgtcggagagaccaatttcagcgaatcgcccgaagggggcaacgcattcccaagtagctcggagaatgtctccggccagactgttgatgacaatgtcaacaccacggccattggtcatgcgcatgacgccggccttgaaggagacgtctcgactggagaaaatgtggtcacgaggcagtccgtaggtcttctcgaggaactcacgcttctcaagactgccgactgtggcaaagatctcggcaccttcgcgctgggcaaactggatggcagcttggccaacaccaccggcagcagcgtggatgagaacgattgacttcttgccgcgagcagtgcgctttccgaggtctccgatatcgtacagacacgcgtatgcggtggtgtacacgataggaatgactgctgcctcgtcgaaggaaagagtctcggggatatgggcgagcgtgccctccagggctcggacatgggtggaaaaggcacctttgaaagcgaaaccaaacacgcggtcaccgggtttgaagcgctggacttggggaccgacccgtgtaacaatgcctgcggcctcaagtccgaccggagtctcattgatcttgcctagcatcacagctagatctttgaagttgacagcggtggccatggtcttgaactctacatccgtctcggcgagtggggaagcgtagagagggtcgtcgtggaagcatagcgagtcgagaagaccaatgtctctgatcttgagcttcagggatcttgtgggatccgcgccaaaggcaacgtcagcgacctcggcagctgaagtctgcttcttgacatgggtggtaatagcagtggactcgaccagtcgagggatagtgactaggccctcaatcaccttgtaagaggtttcaatcgacccctccgtcttcttgacagcgttgtcaatctccataatcttgtccacgatggtatcaacggtaggctcaccctggaaggtgagaatgacaaagtcgagttctggtcgctcaagacgaatacaagtagcgaacccggtaacgaggtcagtttcctggcaatcgtccttgttcacccaaatgagtcttttgccgtccatcatgccctttagcgccttgaggctaccctcagtgacattggcgagcaacccagtctcgatctcagggaggagaatacaagtgctgttggaaagatcgttgtttgcgcaaatctctgcatactcgtcaatggagacgcgttgggtggcatggttaactggcatcgaggcgcaaagcttgtctgctacctctgattgcaatttggagttggagtctgcgacgatatagtagttgctagttgcagatgatagggagcctgtgtctgagccagttatcggcacgttggatacaatgatggatgagacctggtcccagaacacggtatcaacaccagtaaagccagatgtgatgaggggtttgctccaggattcgatatcatctcctccttcggcaacggaaaggacgagcctgccgcctttcttgagaagcgcgtggatgttacccaaaataacctcagcgtcgtcgtccagtccaagtttagtgacaacagcgacaacgtcgtatccatgggcctcgaaaccctgagccgttgggtcttgcttcacatccaggacctggaatcgcagacgctcatcggagaggctctcttgagacttatcggcggatcgaggagtgggatcagtcacatcatactgcgtaaatctttggcctagagtggtgacaatctctttagttgcgactccagtgcccgcagccacctcgagatacttcatcctggggttcttgtgagctagagtgttgaggtacttctgcagccctccagacactccaaagctcttactggcttcttcgaaactcaacaagtcagggtcgacaacccagtcaaagttccaagccttgtgcttggggtcatcgacctgggttgaggtgtcctcgtcgctctcgacttccgtaacaatcagacctgaaaccagaaccttgggttctttggtggttggatcaacagcagtgcaagtcatctcgtactccttgcgtccatgaggctcagtgtctgcgcaaaccaggtagccctcgtcggagtgctccgagccggaaacccaaagctcatcaacgaaggtgagaacgatggcgttcttttgtttgcgctcagggtttgaaatgagaggagccaagcacacttggagcgctccatcgagggttgtggggtggatcaaatgaggctgaacgtattcgtgaggcatcagcttcttgagaattgggatggtggagttgaccttggcgaaagccttgcctgtctcgtggtcaacattggggtcagacacggtctggaatgttgggccgaaaaccagaccgacgttagtccatgcgtcataaatcttcttggcctccactagagttgtacatttctccttggcgttatcaatcgtcttgccgcagctctccttcagtacctgatcttccacgtccacagcattcttcgtctctgcgtactcgaccaagacctggccacggcagtgctcacgccactcgtcgtcatcctgggcggtgcagatctggaactcacgccatggtgaagccttgctctcgacagcagcctgcttgacaggtctgaggtacaaatgagactcgatgcccatggcgtcgtcgggaacttgcagcgcttggaggaaagatacttctctgaaccggaatcccttgattgcctttccagggttcgatgtctctgcaagttgacggcagccctcgatggccatgacgagcatgccagcagcggggtatagcaccgctcctgagacggtgtggtgctcaacccaagggttctcggacagacggatccagttgcgccagatggcatcgtgctttccatcccagtcattgacgggagcaccaagcaactcgtgacgcacgtgcgcgcggttgcggaagttcctgcttagcctgctttcataccagtactccttggagtggttgaaaggatacctgggcagtccaatcatcattgttggctcctcgccctcaatcttgttcacggcaaccaggtcgaccgagaagccgcggttgaacagagagccagcgccttgcatagcactttggacatcgggttcaccacgcttgagcaaattgtggtactttacgataccgttgcccctgacctcttcagtaatgttgcgcagaggaccttttagggcggcgtggggcccaatctcaaggacatctgtgatcagatgagtctcaccagtctcagtcttagatatggcttcgaacatgcaagacacggactcatggaaccgaacaggagacaccaagttggtggtccagtaggctgcctcctgcaacttcgtaggatcaataagagttccgtaggttgaagagaagaattgaggctggggagcagctgacgaccagttgcctctctcaatgttgccgagcatctttgtgtactctgccgacatgggctccatgtaccttgagtggtaggccatctcgacggtcagcttgcgagcgaagaccctctcagcctgcagcatgtcgacgagcgcctcgatctgggccgtgtctccgctaatggtgtggctttccttgctgttcatgcaagcaacggtcagcttcccgctgccctcaaagccaagcttgttgactctgtcgattgcctcggtggagctgtcgaagtccagtccaacggcagccatagtggtgcttggctgctctccggagcgagccagcttggccgacatgtttcctgtgaaggagaaaagagtcggtcaaaaaaggggagctgattaacatatggagagaccgaacttaccacgccagtaggaaattttccacgcagactccttggagatggcccctacggagtaggcggcggcaatctcacctgaggagtgaccggcaacggccttggctgaaaccccccaagaagccaactggtctactagagcgacctgcaaggttgtgcagagaggctgtgagaattcggcttcgttaaggcgggaagaatcagcggccttcatgagctcgtctatcatgccaagtcagctaacgattcactatatgtgacaacgctgttcatagttaacttgacaactgggttgtgcggcataccgattgcagaccaagagcaccccaaagtcttgagatatacatctgacgcttcaacggcagcgcggaagaccgggtaatgcatcaattcaagtcccatctgagcccactgagctccttgtccagtgaaaataaatccgagaccagcatcagcagcaacacgcgtagcaggctgcttcttagaaagagccctgaggagagatccctttgagttggcgacaatagcagtgcgccagttgaaatgacttctcttggctgccagggtgtagctcaagttgtgtagagtgtcgtccaacgatggcagatactccttgtacacattgcacaatctagagatgccatcttggtcgtgagagcttagtacgtagagctgagggccagtagaatcgagcccattcacgatgttaggaaggggcgctgagcctggcagctggggagactcgacggtcttgtggggagcattgtagccgtttgccttaagaaagctgagggcgtcgtccatcacaacgtgagcgttggtacccgaaacaccaaaggaattgatcgacaggcggcggatgcctccctcgatctggggccagtggcaagcagtcgttgggaagaagaggtgccagtcatcgggaatcttggggttcttgttttcgaaccagacattggcagggataatacctctctcgagggtgaggatactcttgacgacggaaccaatgccggaagctccttcagagtggccaatgttacttttgaccgcacccacgataaggggctcctcagcagatcgatacttgttgaacatctcgctgatggcgccggcctctattgggtcaccaaccggtgtgccggtgccgtgggcctcaaagaagcgagtctgtgatgggtcaattccagcttgggcataggttcttcgcatgagttctgcctgagactcttgcgcaggtgcggtgagaccaggggagtggccatcatggttgcaccctgtgttgcggatcacggcacgaatggctgatgagtggcgattagtctaggcctgtctcttgggggatgatgtgcgacttactatcaccgtctctgagggcgtctgacatgcgcttcaggacaacggctccaataccctcacttcgtccgtatccgcttgccctgtcatcaaaactatatgagcagctgtcggggttcagtacaccaagagcattgagctcgagacccatttcaggggagaggatcaagttggctccacatgcaatagcctgcatggtagtgctgtcagcagccgtaacaccagggcaacgtgggcagggacttaccatgtcacagtctccagacttcaagccgatgacagcctggtgaagtgccaccatactactcgagcacgctgtatccagactcattgcagggccctgaagatcatagaaccagttcacacggccggccaaggtgcttgcaatggtaccagaaccagtgtacatcatgggggcatcgatatccttgatcaaaacatcacggtaatcccagatgaaagctcccacgtaggttcctgtctgggtgcctgatacggcatccatggtgagaccggagttctccagagcggtgtagacacactcgaggagcaagcgttgttgagggtccatgcttgctgcctcggcaggggtaatggagaagaagggggcatcaaaggccctgacgttttcctgtatgaagtgcccctccttaccaccgatctacattttcaaggtcagtgaagtcaactggacgggggaagggcgagcagccatacaataccatctcggtggttatcaggatgccagaaagcatctctgttgtatctgtccgctgggacgggagttctggcggatcttccagcgacgagaaagtcgtagaactcctcaggagtgtttccgtcacatggatatttggcatccaggccaatgacggcaattggctcaaccattttcgttctaggtaacgtgtagaggtagatggaaatcaaagacaacgctctccggtttatccagggctatcaatcctcgtttttccaaagaataatgaaagaaaaggctaggaaggcaacaagaagtatctgtgaggaatgagagttgagattcaactgtgcagaagtctgtgaagacgacacgaggccctccttttatcctcagatcctcgagatagctctgccatcttgcttctctagtacgcaactccccaacccgacaactccccaactcgagtttctatctcaataattacgattcctttcggcgtcgggattcgtttcgatcgacctgttttgccccagagcttttatcagagctctcttggggatgccatcctacgctgcagtgacccacaatcaggaggttgaaaagagcgtatattccttcgaaacttttcaatgcaccaagtttcgtcgattctgggacaagatgtgttttgctatcatcttgctgactagggcagcctgcagcccaggagaacctctaacgcgatggggtatacgataaccatggatatctggccagtaggatccggtgacaggcgttgtacaccctgaggatctatcccatgcacgtgtaatgtctgcaatgcattggagtaaaagcgacagtcggtggagtaacgttatcagtgtcaataacccttgccaagtcccacctgtgtatgcttgacagtcttcggtcccgttgatgacagaccagggcgtcaatcctattgctgtgtcccgagatgcccggcaagcacggaccaggatgatcttgggcggattcggttgcctgaaatcctccgggacttgatttgtggccttccgcggcatgtcgtagtggaaatatccacagcttgccactcgctctgagacctgggagcattttccccgaccctgtagcataatttctgatgcttctcttaatttcgaatttccatgttttcctatgttagcacgagcacagacaaggatttagagcaaaatccggctatctcctacgctacgacggcagatctactatgtgggagatgtcggaattgtttgagaggagcagtagaaccgaaaaggtacaggggcggctcgggttctcatggaacctcactcacgagacatgctgactcaattgtcgatgattatcccatgaccagcagcattgaggattgaagttgtagaaagaaagttaggctcttgtcgaatcatgacagacaaacaacgactccagaatatcatattgcccctcctttgcccgagtctattggttggcaggacgccccatataatgcacaacctgcggaactctagccttgttgggcgccttatcgcctttgcttcttaggttatcaagttacagaactctagccttattgaggacatcggacgagaggcttgttctggaaccagtgctaaatagaactttccagagacaaaatggcatttgacatgtaggtccgagtgctaaatgcctaagttagtaggaaccagaagcgtggacgtttgagtaagcgaggaaatagagaaaaggaaaaaaagtatataaagaagcctacatgacttccatcgacgctatttctcaacacgtcccataatcacttgtcttaagcatattattacttgacagtcactcagtcatttacacataagcatacaatccgacaacctggcactatgtctcaagcccaagagctcgtcctctatcataccgttattcgcgacatttacgcgcctatcggtgaagtttgggggatcttgggaggtttcggggccgagaagtcttggtatccagggtgtatcaagctcagcctagagggtttcggcattggcagcatccgcacatttagctatgagtaccctgctggtccacacaaaggggagcgctatgaattctcagaggaattgactgaagtggacgctgggaaccactcaatgacgttcagagtgagaaggcccgactaccccgacatggtcgcgtttgggacgactgcgctggaattcatcggccccaacaaaacccggtttatttggagtgctagaggaagtccactcccacaggaacattcaagagtcttggttgaggacttggacttgcgcttctctggcttaatcgcagctatcgcaaagcaagtagaataagggaactcgggtccaatggtttccgtgaagattgaggattgttggttcagaggctgtgcactcgggtgtcacgtaatacttacctagtcttcagaggtcctaccaagagaatatgctagtgtccctgtgttgcttcgatattctcgatccctcctattcattgtgttgagatgtcgggtctggcatcttctcttgttgttctacttcatactcgaactctctctcccgtattcttgatccctctgtacgtttagtgtcatcccctataattaaatgaggcttccagcaagttaggtactgaacatcctttggtaagtggcaatcaatatgacgtggtattgttccggatgaaggttggattgaacgtgtttctatttctatcggttagatggctccgttgacatcatgagcatttaatatggttgtagaagatatcttcccagcatcgtgttacccatcaacaacgccaagctccgacacaaaatacggtaaagttcagtaaatattctagttaggtggccatgataagcaacagctcgattgtcggatcttcacaaaccgaggagaaaaagagcaccaatcggtatctaggtagcccaagtgtattacaatcacaggtaggtcccaatatcgagacaggctggtttaaacatcccaaagtgctctattaaaaccccgtcaatttcgagaccatcagtactgacaatatgtctctctcccgtagatcctcgacatgagcagactgcacgtggacaactgggtttttttctacgcagcgacccgcgggcaataatgccgtcacatttgaacattgaggtgtgtgatcctccatacggttggagacccgatagtatattatttggcttcttgtcctccaagagctatggttgttcttggctctagatgaagtctaaggctagacactagttacttgccacctagtccactctgacgatagagccaatggcgtcaaaagtatgatcccagattttctggggggcccccattttctccagatcatctagtaagtcgtcctgttgaagagcctcaaacttgtcgttgattgagaatagcgaccccctagatccatgggccaaagtcggggctgcctgtcgcccgttctgcacagggacgccattgcccccaaactccgcgcttgtaagtaaatagaggcatcgctcaccagactcttctggcgtcaattctacaaacgtcccagcaggtggagcggcggtggccttgctggggtcgaaggtgccagcccagctctttaggaatagattagtgctaaccttgccaggatgagagtggatgaagactatgtctttgttctctggtatctcagagatacgcttcagagtcagtgttatcgaagtagcggcgtgggacgcataagtagggatcccaaaacggccggggtgtttgagagttagatcgtcgaggaagaggtttgtcgactcctgcccggcggcaaggacattgataacgcgcgcagattccgacgacttggcggcggctctaagctgaggtaggagagacgtgatgaatacaatatggctataataggacacgacttgagatgcctctaggccctcagaagtctctgtgacagtagttagcccgaatggcccggggctgaccgcaggtgtggcctgattactcgccttggcgcccagtgaaaggcaagtagcctgctgagagaaagaggaggttgattttctcttcttggacggagatactattggccatacgctgagagtctgcgaccatggatatttggccctcgacataaatcaggtttgccttggggttcaaagccctaagatcatccaacatagcccggtgacctgtctcatttctacctacgatatagactttggttggaaaacccttggagacgagattccgcagggtagctttgccaataccgtcggtgccgcccagaaaaacggcggtcttggggacgctggcctcagtaatgaggttgttcgaggctcgaatgggagtgaagaaggacatgatcaccaagaatgacgagtaataagtataaggactagcagtgttagcaaagcgaaatgtgtaggaataaatttcagtttctttcgaagctgcagcttgacggcatttatcacactgcaccatacctgcgtatccgggcttggtggtcccagaagaatgccctgtcaggggatgacatacgctgtattcctcttgagccgaaccaaaacgctcttcgtattggtcatcagtcgcctcttctctaggcgatatcatgaagatatcggcctcacgggtgctttgtcacccacggagagttcccatcaacggtggatgcccccacacgcggaacgctagccatatttgagctagatagtagctcaagtaaaagctctgatcactaaagacctcgtaggatcttctgagcctcaaatcccagctccaccacacggaaagctagccccgtttggactgcccgggaggtctaggtgtcacctccgaggatggttgagctaagcatgtacctcggtgttctcattgaatttgccgaatcatcattaattcatggtcagacaaagaaactaatcccaaggtagacgagacggagcaagcagccaactcatgtttatctaaggattataaaacaagtttgatgccgtgtatgctataatggtttattcgcctcattgcattggtattcccacagcggctcttgtatcagatttatctcaatttccaccttctgcccggttaatcatatcaacgtttcattatgctggtgctcgttgcgggaatcactggcaaccttggcttgcatcttcttgacagtctcgtttctcgtggacatcaggtcagaggccttggccgatctccagataagctcactgacgagcagcgctcgaacgtcgagagtttcatccagatcggaaactactacgacatcgacgctttggatcaagcctgcagcggcgtcgatgccatcatctgtgcctatgccggaactcctttaatgcacctcgatgcacagctgcttctcctacgtgccgccgagcgagccggaattacgcgtttcctcgccgcgagctggaattgcgactggagacacctacaacttggaatgcatcaaagctacgacgcttgcatcgccttctatcagcaggccaagctgacgacaacaattaagccgatctggattctgaccggtggcctgacagaggtttatttctctctccccggccatggcaacttctcccccgcttacaacggaccatgggaccctgaaaacaagactgttgatatttggggaaccggtcacgaaaagtgggatctaaccaccgaggaagacgcggccgacttttccgtcgaagttatccagcgtgatgacgccccagaaggaggcttttgggaattgcactccggtgcctactcacctcgggagctcgcacagatctacaaagaagtcagaggcattgagattgacattaagcaccggggttctctcgacgatctcaggaaacttgccgacactctaaggaatcaaaagccatataacgactactacagctacattggcctattctaccagctcttccaattggatggaacttattctcttaaggcccttgacaaccataagctgaacgtcagaacaacgtcaatggaagactttctccgtcaaaatccccagatctaaccttggaaatagctttcatgttaaacaggacaatcaagagaatggatttaattaccttagcataggtacctagatattggtagatcgtgtgtcttatagcactactaaccctggttgctcttgctatattcaacgaaataaactccgcttagtctatagtttgctggttttcagtcctgagaaaactgatcgaactcagatgttttaggcagtgaacggaccacttgggcgcgaaatgagttctaagaaacttgaatgtgaagatacaccatacgcagttagtttagagcagtgggaaactcttccgcgcgtaacaaacacagacagtgtatgttcaggttgcatggttgcaagaagaaaaagactaacggcgtaggtataagttggttgcctcgcggcccaaggcatcatccccagtattctcatctcgttaacgtattgtcataaatacaaacgataatacagctgctaatcggataaacagcttgcttgcgatgcgaagcaagtggctagaaggggaaagagactgaatatctgatgcatgtatcaaagtatcataaacgatgtctgcattaaagaaatatgccctgagatagtacagcacagtgctggttacttgacgagtcatactcccacgctgtagataacgtagggaaaccacttacgctgaaggccggaaaataagttgagatctagaagtcatatgctattagggtttggcatgtttgtcctgctgcgacgcatgtcctacatgctggcaattcaacatcacactatcggcggaagtcagttatggttcagtgggagggacgctgactcgatgggattagatgaggctttggacgaaccttgagctttttctttttgcatctttggcacgcctgaatacgccgccttgccggcgcatcacggccccgctcctgcaagcctaatgctgttgtgccgtgccgctcccttggatgattttcttgttctatgcttgtcatactgagcccactgtatagatgtatgccgatgggagctgtgtaaatcgtagcatgggttgagaaggtcgaattactatttcgttgcatcgagcgagcgagttcacagcaagtgaagtttgatggaaatttcacgagactaccccgcacaagttacaaacttaattcccatcaattcattgtggggtgttgttccatgtaatgaatcgtgatccaattgtctgcggatcagcctcggtgaagtcagtcgctagagacacgaggtaattttggcccagtctaatcagtacctcttccaccagcttgagcaatcacaataagcttctgagccaagtaattacgagcaaaaatgtcacccatgtcgtcggacaagactccactagcgtctatcggggaatccccgactcaagggcccagcacaagcagtctgcttatatacctcacaaccctgcctgtcctagtatcggacgggcacccgagcaacctctccacatgcccatgacccaacacgaatcctcgagtcatgatctaggtgtgagcactttgttgcttgcaactctttctcatgcatcctccctcccaccttcttccccacaatctagcgcggggagaagaccctgcttagtgattcgctgttattgctggccggtccggggaaacagagaagctggggtctttagttgatatgccctctatttccacaatgaaaatcgaatgattagccttgactttaaaaggatcgaaccgccctccgaaatataaaagcattctgacctcgaaaacctcttcactaacatctcctgccctccccttgtaacctaaccgcaacaagcatcatttgtttaggctttctttgattaaataagcttccaagacaagtagttgtcttagagtcatagtcatgactacccaagcgactgaggacaggaagtccatcgaatccaaagtcgacgttcaattcgtcgaagagcagtcagcattcgccttgactactgagcaaattctgcagcaatacccactgttgaaggacaaaccggtaaaggaaagagatgctctaaacaagaagttattgaggaagctcgacttctttttcctaccatgcgttacgctcatgttaatcatgtggtaagtagatctattcgggcaaacatcaggatcccatcattttcaaactcatgctaacaaaagatgatgaaatgcacagttttctcgatcggatcaacgtaagcaacgcacggcttgccggtatgcagaaagaccttcatatgacggatacacagtggtcagctggtatcagcatgttctatgttggccacttaatctcgcagctccctggaaatgtcatccttgcacgcggaaacccaaggattcttctccctgtttgcatgctctgttggtcggctgtgacaatatcaatgactgctcttagtagcccctggagcttcatattttgccgcttcctggtcggtttctttgaaggccccttcacgcccgcagtgtctttaatgacgtcttcttggtataccaagaatgagagtcccctgcgcatggccatctggcacgctggtaacatcgtgtccaatgtcatatctggtctccttgctgctgctatcttgacgaaaatgcataacgttggctcaatctctgcgtggcaggtatgtaccccacagtcaagttcgcgctcgtaacccccaaatctactaatatgctaatcggatgtacctcgaagtggttcattttaatcgaaggagttgctagcattataatcgcggtttcagcattctggttcatcccaaagttgctctaggatttgcttatactcgttcagctcttctggaccacattacacccgagggcctgaggcaatgaatgatatatcacttgacagtaggccccaaatatcgggacagcgacttgcacttgcctgcgatcgttgcaggcggcgcaagcagaaatgtgaccgaggcgtcccgtcttgtcgaagatgcattgccgcccatgcccaatgcaccactatgaccgtcgatatcgcagcatccaatggtggaaggggttatgtcgaacagctggaggaaaagctccaagcactacaatctctacatcttgcagttccccagcaatccgaacccgaactgttaaggcttcagaaatctacgcccccttctagcttcagtgataatcacagtattgcacatcctgattcagcggccggtagcgaaaggcttcactcagtcccggacattgactcacctctcgctcatctaacacttgctgccatggccgtgggaggagaggtgcggcatgcttataatttcactctagccgaggctatcaccaccgtctcgagttgcaatggctccatgctcaccatgcacgcgcaggatggcgcgtttgtctttggcggcatccttggggaatcaccagcaacaagtttgtcacggcttattgccgcaataccgagcgagcaagcagttgaattgatcgatagctactttgataccattcatttgatgttcccctggactgaccactctttcatcattaccatgtactcccaaatctcatcacgaacaggacttttgcacacaccgatggaggagcttcgaatggcagttgtgctggcgttaggaatggccatgtgtggccgcacctccgaggccgacctactcgctcattgcatttcccggcaggtgaactcatacttttccgttccatcccaaggggagccggatggattactggacacgcagtcattactgctactgtccattctgtctttataccatccaggcgcgggcctaacttggcaccatgttgggttgaccatcacacgagcgatttcatttgggctccatcgggagcccaagcatactgattcagtgtcctcaatggagcctcatgtctgcgctcgcaggaacaccttttggtctgcgtattcactggatcggtaggtttgccttgaaggttcaggtcacggagaccgcatgctaatatgcggcatagcattaccagtctggcgctgggaaagccgttctctatacaagattgtgacattacaacttctataaggcatacttaaagctgactttcttgagtacttgcatttagactaccgatttctttctctcgttaccgtctttgaatagcttccactcctaactgatcagcgatcaaaaatgcaaagcacccccgctttaaccaatatactatctcgcatctcaagagccaaaggacttgataccagccaccactactttcaattgcacgagtggaaagatcggataaatgccgcagatacttcattccgactagcatacagcacgcaattccacgagctgctctacctcaaagggctcctcttgcttttcgagttgaatcccgcccgcgaatacgtcggctcagctacggcaatagaagttctcggtgcctgcacaagagtggtagagattgttcactgctggacgctggcgaagagaacctgtgctggataattggcagctttgttttcagcgcgggcattttatacctcgacattgtgatacgtgatcgctacgcgcggtcgcaacagtcactcacggacatgatggccttctttaacaattgtatttcgtcgctcgcttctcacggtcaaagatttccggggattaaaagttaccatgagctctacagctccgtaacggccgcggcttctcagctctttgagcgcgagcgtgtggtaagtcgaagattatttactcttgatcagaacaaaaaaatttcaactcatcctgtatttagagcaataaccactccctacctcttgagaaggagctcgttgactgtagctttatcaccgatctatcactacgcaaaatagtcaaggatatctttgtagtattgaaggactgttagtcattgcctttgtccaattgacggggttttgatggcttcgcttgtctgacggctcgcttatcatgcacgttataacctgtgcttaactgtaattatataacacctcctgaaatattataatgctctggtcgtatatataactataatataccatattataacactggtattattctttcatcgccttcgccttgacagcgatctaggtgatcgtgacgcgaagtccgcgtgcaccctttttcggctgtggcgtcagcatatcgtagtcgtaagcaatatcatcccatttagtatcgtatatctccatacatggaatggaacggagaaccatagccgccacgacgaggtagagctcgcagaatgcaagactgggcgtaagtggttagcaagtcagctactatgatgcggagtgggacgtgggtacttcatgccaaggcattggcgagttcctctgccgaaacaagtcatgtatttctccagcgccttgttcttctgtccctgggcatcaatccagcgctcgggcacaaactcatacgagttaggaaacacgttctcgtcgtggtgcgctatagacgcgctcatgcctatggcggtgcctcgggggacgacgtattggtagtctccgttctggtagtagaggttttcgttacgtgggaccaacgcaagacgcgaggacatcccgtacgacaaccggagaccctcgtagatcactgcattcaggtagggttgctgctccagctcacaccaagacagctccctgggattgatgcctttcagatcctcggtaaggcgagcagtaatttcaggtcgtgttagaaggaagtatgtaatcacaatcagcgtattctgtagagcgatacctgttagctaagacagtcatgtccatatgctttggggtaatatgtgaaaatgatgtttgactttgcacttactgcaggtgactcggtacctgctcctattagagagaatccctcgccagagagacgaaatagcgttttttcctcctccggaagggatgattcgagtagctcggtgaagattcgacccttggcgggatctctctttgcttttatgataagatcaggtattgtctcatgcatatatttcatcagacctgcaacatcgtcacccatgaacttgcctaggtagggggcaaaggcaaccaagtggctcaggaccgggacgaaacgaaacaagtactgcgtccttgagattgcttctagcgctggctttaaattgggcagccacccgtcttggtccaagaatccaaacggcttgccgtaggcatactgtgagatagtatcgccagtaaagcagccaaagacgtgaatcatctccacggggcctttgccagcgtacatgaggatcttgtcgcacattttctgggccatggcgtggacttcgggctccagccgcaacatctgtgcgcgggagaagaaacggctgacggcgttcttacgtagtctgtgcagctcgtgctcctgagtggtagccgtcgccacctttgctggtccgggaaaggacttcaagaaatgcttgtgtctatcacgtactcgtgcagtgctagccggagctatttcttcggcgaaatccgggtcgttgcagtgcagctcctcgggattgatccgaacaatgggtcctagcaactggtttagaacttttacggacttcagcgtaaacacgtacagtgagacatgccgtatgtttcgtgcattcgtttgatttcatgtgaatatctgcctacaaggatgagatcgtaatataattcataaataaacgacatggcggcgagcctgggccccgggaaattgtaaagggggtgcaaaggtgaaatattgtataaacccagcgccaacttgtaagcaagatacagcccaagaaggcgtagaatgttcatgggagtcaaggtggctaccagcccgtccaggggcaaagacgaaagagcaattgatgccatgacgccgaatgatgatttttgcttattggggctatgtctgaggtcgcattttcgaaagtggaaaagaggaggcagggtcacactgggcggtcatcaacataagtacagcttccctctgccatctttggtgcggggtttatggagcgagtttcctaatccgaggaagccgaggaggcctgcatcgatagtgccttagggtatcacgttatccaattgcacacctactccgacatatcttggtttctttcgcgcttgagtgtgtaccgtagtgcaatactctccgggccaatcggacgccggtttgacctgctcttatctcagcacagccaggaggcttgtgctacggaggattcgccttcgaatgccctaagtataagggaaatgcagcacaaatttcaatctgaatttcaaattgttccgtccattgactttgggcccttgagtttcgagaacgatattcctggtcgtgagatgactcgagaagctttcacagctgctggtgttaccggaaagcaagcacttctctaacattttcaaaacatatagtgttgagtatgtagctatagccttctcggcggcggaggttgaggacggtaggactcgctttgctctttgggctttgccgttgccgttattgcaggcattctgactgtgcccctttaggtattgtttacggcaagaacggctcttgaagagcatcaactgagtaacgtgggagatttggaagtctccatgtatcgtgtttagcaggtagataaagagatggtgaaaatggagcaatcaagccagtggacacgccgcaagaggttttcatactgacatgttctattggaacgctaaactggatgaatatcctagaatacagagaatacaagccccaagaccttaaatacatcaagtgagtggccctagcagcatgcctagacaaatagttggaacctgaagccggtcacaatgtgaggatgctcgggacaactcaagggcaagaagggccatagtcttgaccaacatctatcgctaaaaagttgacaaaatagtagtgtcaaccccaaatagagtgatatgtttacctaggggtattggtaatataacaagggccctgtgtgtcggcattgattgatcggagcgggtggaaacgttgctctaaggctttgtttccattgtggttccaccgtgagccgaagatgtcgccttgctcccttcgaccaactcgtgatacgatgcataactgccttgggcgcgccggttagagttctcaagtgtgtattgcgtgtcgcggctgcggccgccgaccaactgtttggccatactgctcatagatagtatagttgctgggagcttgagcttagtgacggagctcagaggcggagcacatcctaggatgatgacgatcgtttgttccacgatggcgaaaaatagtcccaacgtgttaccataaagcgacccggcgctgctcgtggcatggacggatttggcaatggaaatacccatggtgacgagggataaggaaagaagaatacagagaccgagcttttggcggaacggcatgttaagcttccatacgaccaagactggggccaatacgtaaaccagatccccgaacgcaaacagagcttcaaagagtcatcgtcatcagtacggcttgtagtcaatcgatggatgcagacagcttaccccctattatgttgccctcaatcatagcaatgtctgggctaaactgcagtttagcgcctgctaagggattccacaagccttcgacaggtttcatctggttccagactgtgatgatctgagccacgacggccgccactgagagtgtggttgtgactatcacgagccacttcaatgcgtgtttaggcccaaagatgcggacaagtaatatcataatggaaatcctcgccgtggcggacgacagaattgcaggggtgtacgacatccatatccatttgccagtgttgacgatctggtcaaacgtaaggtcttggtcgtgcttcccgagaccataatgaaaggcgacagtgagaagggattgagcggcaaggttgagtagctatagagtctgcatattagagcacgctgggaaaggtttagttggtgattttcttacacaggcaaataacatgatccagtcctcagcatacattatcatagtaaccgtgaggcggacccaaaaacgaacagcgacggcgagtagacttagaatgctcagtgtccacgtcaagcccataaaccaaatgccgcgtccagggtcatccggatttacgggcgccggcatatccattgcaattgatctgttgttggggccggataccgtgagccaaaacgatgtgatgtgcgaagattgcaatattatttagcgaataatccatgcggatcaaaaacttggaggtacaaagaaggacgacaaatcgtcttatcaattcatgcgtgagacacggcgagacttgaaatgtggaaggttacacatcacggcctgggcgctcatccttctctcccttctctcccctagggctaacgtagttaagtagcgagtcctacctttcgccattcatgtaagccttactaactatgtagtatcatgcacgactaatcatccttacatggtgttaataaagtcatacggctgaggggggtatctggaatgatgatgggttgccaccttggatgtgtggaggcagcgctggcatctcgggctgggacctgaccaatcaactgtgatggaagcaataacattctagttctctacaaggagctacattatacgcaccgcagtacagctgcatctgtatagctctctccagattttcttgtccccccatgtactgatattacccgacaagggtggtgtggggcgggagatgtcgcaaaaccgatggtaacccaattcctgaaccaaagttcaatccatataataatataattaggcatcagggtacataaatatagtcagcaaggaggaaactacctactggatcgaggtatggtcacattgatggtatgtaagactcaacagtcctctcggattcgacgtttatgccttctatcacacccacctccacgtcaagtaagtgcacaacgtcagcaagccaagtgtcagggctgatggattccgcgccaccttcgcacgttcaagagtggcaggcaccatttgaccggtacaaaaccctgcagtggtgcatcttgacagcagcaccttgtgatggaaagatgtcgtggcctccgaattcctcccgcccagcctcccatcagaaccctccacccctcctattgttcctaccctcctattgttcctaccctcctattgttcctaccctcctgcatctcggtccgacccctccacacctcccactgctcctgtcctctcggccttttatcagacccttccacccctcacactattcctgccctcccccatctctgtcagatccttccacccctcccactgttcctgtcctctctcaccttcttctctgtttccgttaaaaaaaaaaggcgctagctcccacatagcaccttttgaacatgatgttttgaaatagtttatcaagtttaatggataaaatattattttatgcaaacggctggtcgaaggctggtcgaacggctgcaattgtgtatggtacgagggcgtgcgagcaacaacagttgacatgtaaaagtagtcctacatgataaaataattcctagaagctttgcgatcgaatatttttagagatggaagataccacaatacaagacaaatacgattcattttattattgggaacaaagagctgggagtagctgtaggaaacctgtttggtaaagaccaggcctcgacctaatgttcgaagggagtccaagcttcactttggtcgacccgatctcaaagccgtatctcaccatcagcttgacccaaaaaaataactggttgtaagctagtaaaagctgagttgagaatagaaagtactgattccaccatgtacctcaagctcgggcctggaatcgatagactgccaagccaagttatacatcccagtgaacttcaaggatcgacaggtttgattcattactctcaattacccgacgaaggacgaatcgctgatctgccgctgcgagaagcgctttccattcgtccagatgtctgtcgtagctgttgaagtagaacttcaacgccatgtcaaccgacctagagtggttttgtgaatcagcatacgagctcgcctattatatgatatagttgcatacctcaaaagtcgctctctccataatggactatcactgcccggcgctggcaggactgcatcctgaatgaggatctttgctccgggccgaagggcgggaatctgagcttgcaagattttgatagccttctgatcggtccaagaacggaggatcatacgaaagaaatacacgtctgcttgctccgtctgagtttcaaagagctcgtgtggcatgaacttgacgtgctctttcaatgattcggggacggccgcgtcggcgccgtcgataaccgctgccgaatcctggacaagcagcttaaggttctcaaacttacttgccaggtcaatcgcgactgatcctcgttgcccacccacgttcacgatgcgtacatcacccagggaagcccaattgtagaatgtggcaacaaaagcgtctccgcaacctggaacatgatctagcgctttcgccccgcccgcaaaacgcttcgctgcctcagggtctgagcccagtacttcaaatactgactttcccccgttggcaagggcgtaggcctgcaaatattagtccaggggtcgctcgaattcatggtattttgtgaacgcgtcggtcagacatggaacatggtctagactcacagtctcattggcttcttcggagtgcggccatttctctatggcttctccaatctggtgtagggtgtctgtgttagaatgaggctctctgtgttttatgggaatagagcccttactctcggaatagctggccaggtatcgtggctttcaaatgtggcccagtcacctatatatgggatggccaaaaacttggaggtcttggtatgtgccaccacatcaggttcgggttctgtcaggatgtgcatggatatcgcatgtcgaagcaggcgtctgactagcctcttgtcgagattcgttttctgggcgatttcttcaaaagtggcctggccgccaggggggatcatgtccagaatcttgaaccggacaattgagtcaatgctgacgacattcgagaccttgagagcattagtttccggatacctagcggagcttgaaagatcattaccccggcaaatttgtaaatcagcatcagaggttccaagagaacctcatggagctcagcagttgcatccaacacttcatcccgaagttggtgcaaattcgaagggaggtatggagggctgttctcagcccaggatggattttccagtccctgggctgccagacctacttgcagctctgccaccgaggaggttatctttgcagccaattcgacgatcaagggggcggcgttggctagtgccattttgacctagaagcagtgtggtgaagtgtaaaaccttagggtaagggtgggcgcgataggcgaggagcggtacctgatctaacagatgcctgatgtggaggtaaaacttgaaagagagagttccgattgctgacttcggtctcttccaggtttaggatatgtatggacgactttttccgattcgcaaggaccggatagagcggcatatcttccatccgaatgtgacacagtatcagaactgagctgcacgcccccgcccccaggaactttggtttcattagagcaaagggtcgcagctattgtctcaccggtcagaccaccaaccagcaggaatacgaggttgcaatatgcaaagcaaggccaacgggacattcaactgcattcaatcaagagcttgattaaagcaggcttggcaggctagtagctcagctgatgttgctgatcgacccaattatcgacaaggggtgagagaccccactaaagtctgcctagcctagtgcattttcaagcgagtgccttagcgaatggggtaccggtaattgttgcgggggcgggacatccccactgcactactttagcacagactttattatatggaccttttgaacctccaatattaacatgtatctttgtgttggtccatcctgatgcattgtgttggatcaatgctgacgccagatatcacatcgggattagcgctcaacagcgcgtgaacatttgttatgtattttatcactataaaccctagtaaaaatacctcccgggttttcaataagcgaggcaggagcgatcgatgcataaggggtctgccgagaaaggggtttgttgcgtaacaataatacagcactcacaacaacaattgaatgcacaaaattattgacccaaaagagcacttattattagtgatattcgttcgaaatcaacatattggcttggtttgtgagcacgatacaattgagcatctggggttttaattgaccttctttcaagccacctctaccacgatcgtgtcggcagccttggaacatcattagctagcttagaatgaactgtgacgataccgattatgaggtgctggcaagtcagattgaatcacttcttaagcgtccagatggtgctctacagatcagggatgaaaaaactcgccgccgcctagtcgaaggcgcgcgcaagctggctgaatctctggagttcccgagagagacgtatcgcagaatccaatactcagtttgtagagcccattattccttctaccgaaagctgcgtgactgactgcagccatcaatagcatctcgtgctacctctggctgtcgtcggagtagatactggggtcttctccgcattggcttctgaaaaccgtcccttttgcagcactgagcttgctaagaagactggcgtggacacgcagctcttgagtaaatagaatccgtcctgccaccatactataaaggtgctgacaactttcaggaagattgttgcgatattaccaagccaccgatatgatttctcaggttgctgttgatacctaccagtcgagccctgtggccaatgttctgagtagcgacaatcacagcgattcacttcgattcacgtaggtatctattgcaaacaactaaattacctccgttgacgaatttgcataagacataaaatcactgcgcaagggagctcaaatcttccagattggctccgatcaattcagtatagttgccctgttggcgtttctccgacagcttggacaagctcgattcccagcgagttggatccctttacttatctgaagcacaatccttgggcattgaaacttttccaatcgcatatgatggctcaaagggttgggagaaaatcacttatggatgctttcgacttcaagaagcacttaaatacccaagatataagcagctcaacgtttctatttgttgacattgggggcggaactggatcccagtctcttgcattccggaaacaatattcaaagcttcctgggcgggttgctctccaagaccggccagaggttgtagagcgcgtcaaaccaatgtttgcaaacattgagaatattgaggcagaggtttacgatttctccactacaccgcagcctattcgaggtatgcgccagtcatgccctaggtacttgttatgagacttctcagctgacttttcttttcttttctcttcttctaaattcaggagccagggtctattacatgcgaaacatcttccacgcttgggcagatgccaaatgtgtagagatcttgctcaacattaaggcaggcatgaccgaacagtcagtactcatgattgacgaaatagctatccccgaaacgaacgctaagggccaggcggcccagcatgacttagaggtcatgatttgcgtaggtaagtgcctagagtctccttgatgtatcttcgaaatctgaaataccaggccgctaagtgacgagtggtataggtggcgtagaacgcactgaaggtcaatgggcaagcctgctaagtggcgtcgggttgattgttcatgagatagtgaaatatgacgaggattacgaagacgccttaatcattgcaggtcttgcttgaccctgtgtatcaggaccgctggcacatccaataacctgagagttgcctagaaagctattcaagaatacacgtcagaaccctcctcattgatttacgagtagaactcctctatctaaaggttaacgaacctctaaataaattgcagcgtaaccaatttttacttcctactagctatcaagtaatgtactcaagtggcagggaggtagataatatggaagactctaatctagttggctgtattaattgttacccaatagtatcaatatagatgcatgaatgtcaagaatgataattaaaatatgtacccgttatataacaatgtatacctagaaaaacaaaatagcccacgtgcctttaccagtggtatacaattgaccaattgacttcctccatccctaaacaacttactcgtagaaactaaaaacagggatcaagctcaaagagctaggaagcattgggaattttcaaggggacacctccttacctggaactgcctccttaacttcttctgctgagcgatcggcatctgtactgtcaggtttggcttctgtatcttccatcgccttctttcggatgtcattccatcccatcccccacgaggcaaaccaacaaagcgctccgaaggccgcccccaagtagtagacccggcccaggctgtttgagtatgcaactaatataccgtccaagtctgcaggcgagacgatggagcgatagccggaagcaccggcattaataatagcttgtgcgtcagcgtcgggcgcatatttggcgatttccgtcggcaaactctccagaaatatcacattatagacggtattcgcgatggccggtccgatcgcctggctaaagaccatgaaagcaataccggaggccagctcttcgccgtccatcgcagcttgcacggcgataagaggctggagttgatagaaatagtcagaactacgccgtaaaggtgggtttgttgctgcgtaagaatacgtaccatttgcagccctgatccgctgccaacgccaagaagaatctggaaccctacccaacgggcagtcgaggtgtctggttgaaggagggagagaagacctgttccaatagcaaggaaaactgaagcgacgagggttatgggaatggtatagccgaccttttgtactatattgaatgttaatgcatcccacacgccaagccatctatggacgggggctcctcaacttacctacgccgcctgaagcgccagccaatacaagttggaatagaatcaatggaagaagaaatacaccactctttactgggctctcgcctttgacagcttggaaccagattgggagataataaattgccgcatacagcgctgatgtctggcaagcgttgtataacgacgaggccaagacatttctctggcggatcaatgcacgaggaatcatcgcatcttctcctcggtatcgattccacaatgcccagacgacgaaagtcgccgccgcgccgacgaagaggccgattacctgagaagaattccacttgtagatccggccgccatattgaaaagcgaggagtaactgtacaattgcaggcgcgaataggagaaagccaacgagatcaagatggtgatgcagcctcggtagcagcgataaagctctcggtttgattgtcggttcaggaatccgtagaaggaatatggaaatgaccgctagggcgccaacgggtaggttgatatagaaacctgatataggtcagtgggcaaattacccggccaatttgttcaaatgcgaggtaaagtagtaaagcggacatacaccaacgccacgtaacataagacgtgaaaagacctccgatgagaggccctacaacgagtccaaggagattgactgttgattgctagtaagtacgagttgtatataaggcggatcaagtaggatccataggcaactcacaagccattgtgaaacccaacagtactagccaggattgcgcgtcagtccctcgtcaggtcagacgttgtgttgtaatcaatctcgctcacctgctcgcttttcaagaggcgcgctgtttgatatcattgtgatggtaccagtcgcaacaccggcgccgccaaagcccgcgatgaagcgaccgccaataaggacggccgacgagttggcagcaccgcaaatgacggagccgacctcgaagatggcaaaaaagaccaaaaaggtccactgttgcagcaagatcagacagagctcgaaacacgatgggcggcgaaggctctatacgaacttttgtattgaaatacttgtagatttttccggttaatggttgtggtgcggcacttcaatcacagcaacagcagtgtgagacagctgaacattttgatacgtgtgtgtttgtgtgtgtacacggatgggcggttcagacttaccttccaacctgataggcactggcataccaaccgacgtcggcgagggaatgaaactggtcagtgattttcgggacggcctatgtcacacagtcagttagcttgtgatcaacgtggttgacaaagatgcaacctactgtgctaacgatcatgagatctagcatcatgaggaaactggcaaacccgacagtggctacaaggatgacgagcttgacgccggtcacatactcgggatttggcactggctcgatgataacggcatgcttccccgcgtcgtcggcacctgtactgatagcaggctgagagacggcctccggcggggcagcgggcccggaagcggaatcgcgctcgggggactgggatgcagccatcgaggattctggagccactagcgattcggtagctgtgggtggtgatagacgtgtaacgctgagagagccggggggagaaacgaaacttgaatttggaaaagagaggctcagagctgggcaagttggccagtgtaggctgttggcttgtatgggaaaggcgacttgcccaagaattcattctgcattagcatggtcctattactaatagcattgaaaacaaacagggcatggcaataagtgcacgggtggtgtagaatgatcagcctacaaaagttcccggcctcagttacattgcataggagtaagtattgttggccgagagcataaattcgcggcttcagttacattgcataggagtgagtattgttggccgagagcaaaagctgaaggcttcagttacattgcataggagtgcgtattgttggctgacagcaaacagcaatgacacccactcggcctttgctgtatttatcacggatatgtacatgcgcatcacaccccccctcccgtctctccaaggctcttggacggagaagtttccgttttcttctttggccgtgtctgctgtgaaacgtcggagcctcgcagtcctcaacatggattgccgttacatggaatcctttagttcgaagggttgcgtcgctgtgacatcaagagttgcaatatcgtctggtgtcgcctttcttcgtttgccgagctcccccacgctgacaatgcatactgatattggctatgacaacgcatattgatgttggttatggcaatgcatatcgatgttgattgtctgcatttttgacgctccgttggttttaccctgtgcgtaagcagtacccaggcactgccacaatgctacccatcaccgtgtcatgttgcatcaatgtgacctgctgcccatcaatgtataatgctacctacacacccatcactgtatcgtgctaaccatcaccgatacgacaccacaacgacaagtgttctttacattgcaatcggcgttatgcccttggtcttgaagacagcggatcagctgacagctacgtggtattttcttttcctccggggatgttcggaatagcatccgggccttgcaagttccctaacctgtactttctttagtatagcatattcgtacttttctaggtagctgaagtcttgagttggcctttgagatagttgcgcatcgcatcactcaacttaattggtattcagaaagaagcagaaagaagctccgaccatgtcctcacccgagcactcggtgtttgtctgtagcgcaactggttttcaaggaggcgcagttgctaggagagcccgagagatcggctggaacgtacatgcgacgacgcgtgatctaacttcacagcccgcgatggccatgaagagcattggtgtccatctaaatgaatgtgactgggacaatcttgctgtccttagggataccattcaaggctgcgataagctgttcttgtgcctcaccatcaattgggatgaccttagctgcgagcttcgtcaggttcgtcgtcgttgaaagcgaccccagctcaagttcgttcatatgggcttatcgtctatttccagtgccgagacatcttgaaaatcgctaaggaggctggcgtaaagcaggttgtttcttctaccacgcttggtgtctcgatgctagactcagaaataggcgtatatcccggatcattcatggagaagcatatgattaataagaaggcaatcgagcaagcagttgaagactgcggtttcgaccacttcacctttctccggccgaccttctttatggctaattttattgagcccaaggtcagccgttatgctgaaatacgcgacaagcgcagctggactacatctatgacgcccgaaacgcagctaccgatcgtggatcatgaagatattgccaaatttgccatgtccgccttccaggatcccgtagcctttcatggccatgctatcagcctggccagcgaccagctgcgcgtacaagagatcttggaccttctcgcggaagctgcgggccaaccgggctccgttcgagcctacttcttgaccgatgaagaagtcgaggcccaggctagcacgagcggcttctcagactcacacaaagtactgcgctatgcatcggaatatgttgatctggagaaacttagggctactgtgcagttgacatcctttagagagtacttggaacgacatctggaggcggtgagacttacttttcctcatccatagccgtgcagtgaaattggtatttcgcctgtgggaacggcatatcattcaatttgcagtacttgtctactattcataataattgagtctatggttattcaggcaaaaactcgactttgtgatcgtggccttcgcgactctgcccgatggtgctacccggtagttagtggccaaaagtccacggccgacttccagtatcttaagtaccctaaacctactactttcattttaaatactccttgataacttatctaaaaacaacctaattagaaaagaatttcgatatcagactttagtatatttaatatttatatgatcttttgataataactctttattatcaaagagaaataaaggccctgaaggactaatgaagtccgctgcttttccaagcgtttctccatatttttctatgcaattgagattcatatgcctttttcacaaattatcgcaaatcgtcgtctgacatatttggcaaattgttttattcttcccattatgctgtcgtttatggcgtgtgaagttctttttcgaaacatatctatcgcaggtagagcagaatcgatggtcgctaggtacatgacattttcggggtctcagttgcaacatcaggggaggaccagggtggactagaccggcagaccagcttcagtgttttactcaagacggctgtatgtttgcatgtcgttattcttactcggctctttgaattttcagattgcttctggacttccatctccgcaatacggtacgcgctagtcgatgagcaaacccgtaggggtaaggttaccacgtgttcaggaatagctacagggactcactattatcgcttactttttgggtcccaacggccttgaaacggagtacggagtagaggaataatgttcagcgctatcacatcccaaggatggctgttaagatactcatgaattgcgatggtgttctagcacatggacttacttaactctgtgtaagagacagtcttagatacacccgaactgctgagtcctgactcatcccctggttctaagtcatgatatcgcgatgaacacataaccccggcgccggcgagatccccgactggtattcaaaggcctgcaatgatcacacattcatagtactctgcgtcatacgttattacttcacgtagtttgagccccgcttcattaatcaattgttcccactcaagttttgtgcgctcttttgcacctatagaaccccaagttagcgttctggtatcgtgagcattctgtgctatgtaaacgacgttcacttggactcaaatatgacccattaagttgtgaagcgttggagacaaccaaggagtggtaaaacaaataggaaaggggaggacttgccaacgctcatcaacacctcaatgtcatgctgagctgctcttggtctagtaccttcttccggcaggacagtttcgtcgatcatgattactgacttttcagtcaagcctgcctttacatttgctaatatttccaagcacttttcatctgcgaaggagtgcaagatcttccgcatatagtacgctcgcgcccctgagaaatgagtaagccgagttagctagcatgcctgatatatagagctttcgagttaatacctttaattggctcaggtgtgaaaatatcatacacctccaattcaatatttggggttccgtctaatgctgatttggctttctgcacaacctccggccggtcttgtataataacccttccaggaagacttgggtatctctgccgaagctttaatgattgagagccagtcgaaccaccaatatcaatgaacaaaaccgtcgagcttgtgcagtcggtgccaaagcgggcttggaagtccaacacatcgaaaaatagcggtctgccttcgaattgaaccttcatatacgcaagggtgagcttcaatgcccatggattctccccaagccatgcgtaggcatgcttttccgtattgtgagccctagatagagctgtcggcatgacgccagtggggtctttgtatccggtggattggagtaagtcaggaagactgaacaccgggggacccatgatcttgtgcctatcgcctttgtcagagcgttcagcaacagagaaagtaattataattacgcgaatcgaagggcatcggcgtggtcttcattactgagaacctgagttacattgctgctttggtacgcatcattgccgacttggcatatcatgtcaagggcttggtagtaccgcagtagcctttctaataagcactgtcagaaccacttgtcggcttcaaagacgaagaatagagacgcatactcaggaggcttaagggcacgccggttttctgtgcaagctcattgctggtgaaggatcgagattcggctgctagggcggcaaatagtcccgtatcggcgccaatgatagccagtgggagctgaaagtgctgatttaaggttagaaccacgtcgaaaactttggtttctcggagcaggaattttaagtaccacgtgctcaagtctgctcatggtgtgtctcggctcctccaaaaggatgctgagtttacgcccaccgtctgcaagacggcgacgaatgtgttcatccggaatgtggacatcaggggcttctggattctgcaaaatggattcaatttgttgtgctaattcttcgtattgtgtcgccgtcgacttcattttgatttgaatcaacgaaaaacagaatcttagtaaatgaaggagaaacagagcggtcaggcttgaaagcgaccaatgaatatgactaagtgacagaggccgattaccagttgaggagccttccacaaggcggtgcaaatgacagcgctggcacatgtattctgaaagcaatgatattggtgtatatttcagttacttagcctaacataccagttaggcaatatgcaccaaacttggactgacgtaacatgacacgcccatgtactacccagtcttaagaaagagggctattacgcgtattgcctccacagacctgtgaaaatagccagcaaggcatgggcagcccttgggaaccattcggggtggatagccatttcaaaacacccaaagtcaaagccactgtgtatttcccagccttattgctggccctacgtggcgccacgaatccttgcctgtcacctgcatcatgccgcttatccgactctggtgcggggtaagtatggtaagcgtgcgtcaagtagtacgaatatcaggggtgtctttaaaattaaagaatgatgcacaaggcggggaagcaggggtcatactcaggggtccttatccccacgcctcaaccttactctaatccagtgcaagaaacggaccagttgaaggtgagaaacccccactgagccttgcttccagatgttacgggtacccgagcatgccctcgaactttcatgaaatacgtacggttctcttggctcggctctctgcgtttgtctgtggcttgagtgtatgtatccctttgacttggttgaaattatggaatcatcatctacaaccccgcgaattgtcgagttggctgctaaaataagctcgtctgtttcacagctccaggagcttctatcagctcaaggtgtgccatcaccgtcgttcacggaggatagcccagagcggctgccagccaatactttcgacctccaggatgccgtgcttgatgcgactaccgagcttcatgaactgctcatggaacctgttcgcctgatatttagattctgtgccgtaagagcccctggtattcaattgaagggaacatgtcaagctaatgtccgaagactacaaacatggcgggtatcgacgctataagccgatttggcttcgctgatgcagtccctatcgaaggccagatctcatttggtgagattgccaaagcaacgggtctggatgaaccacatgtccggcgcttgcttaggcacgtaatggccaggaatattttccatgagccggagcctggcatggtagcacatacaaaattgtccaggtacttcatcaaaccatacatcaaggactttgtgggatttggggcccgagaaggttggcctgcggctacaagggtgcgtttctcagctatcagcccaagcgagacttgatatgttgataggctgacatgtgaaatctaccgcagatgttagacgccatccagaaatggccgttgtcggaagaggccaaccatacagtgagttcttagcctttaagcctttatggtgatgctttctacatctatgttcgcggacactaatgcccacagggcttttctcttgccaacgatagcgacaagtccgccttggaattgcttaccgcggatcatgcacgggcgatgcgtcttcagggtggcatcgacgcccatgaccactttgccggctgggccgctacggatgtcgccgagctgtatggctgggcctctataggcgaagcgattgtctgccacgtcggtgggcaccgaggcgaggttgccgcactgctggcgaagaggtttgaaaatctcaaatttctcgtacaagatgcagacaaggtcatctccggcgcagaagctgcggtgcttgatgatttgaagagtcgcatcgaattcaagtcctatgacctctttgagccgcaaattgagcaagccgatgtttatctattacgtctggtgtttcagattcgaaatgataaggagactctaaagatactgaaagcacaaatccccgccctccgacacggtgcaaaaatccttataatggaaatcgtgatgccggaacctggtgcgatccctgtctggagagatcgtgaactgaggtaacgttcattccttgactgttgggatactgaaggtcgcttacaagtgatacagagcaatagacatggctatcggagctaatttcaacggtcgcaatagatatctaggcgagtggaaagctctacttgcagcagctgatgcaaggtttcatcttcagcgggtcatagtgccagagagatcactgctatcgaccttggagatagtatgggatacgtctagttctgccgaagcttgatgggtcgccttcctcgttggatctgaactgatggattacaaatgcttggtcacattccatgactcctacttaacccgatatagtgaataggctgcatctattaaactcaatcatcctcaggagcttcattccttttagttacatgtcatggatgttctccataatattggggtagtggtgaagtgtgggggtggggttacaatgtcatgcgttcgcttccagggggttcggatctggaccaggatctaggcctacataacaaatggataacaagtagcgttgccgaagagccaatcattgttttcgtgtttcacacgcacaacaatcaaacaggccgcatatacgagtacaacggtgtcaatagcaaccacactgctgactctctgagcagaccacttgcacacccatgtttgaagcctgtcatgctgcatcttccatttgatagacaaacagaatgtggcaaaatgtaaccctatgatactaggaaaggctcgctctccgagccggagggtttagttcgggccgctctgtggggtcaaggaggctttaattaccggcaccattagaattcggcatactttacgatatacggtttgcttactccgataatgctatgttacccaaacacagttttctcgtacgtcgaccactcactgcgctttggatcatcgaacgcttgcgcgcttcttggcctactgtggataaggacaccactcttaacaccacgcatcaccttcgtccacgtcatctcgatttatggaaaagtgggagtgagaacatggagtatcactgaagccaccccatgcccatggaaatatgcagataatgtcctgggtggtaatgtgacatgggactcagagatctggagtgttgtctaggccttcaacgcctttaatgcccccagcggtatccatgaccgtaaaaccaaagtatcgtgactattttcgctatagtgggatactatgaacacccgagaacgctgatgagactccgtatgttgtatagagctactgtggaggcacgcgaatacaggtatgaattatcaatctacaaactagctggttgcctgtgtgtgaaccctgtgtactgccatgagaatctctgacaaacgacgactaaccccgggtacctggacaagagaatcatctaatggaaaaccccttctgaagaacagaccctctaccccgatttccacactattccttttgtttgattctcatctgtgtatttacagcaggcaccatggtgttccctaaagccattcttttagctggaccaccgactaactcgacatcataatgcaggacaaggtatgccaaggcctgcttcatgacctgtacagcaaagtaccgtccggggcatgcgtgtcttccgtaactaaaaggaagaaatgttggcgttgtcgttgtggcgagttctctttctccgatagcttccttctcactctcaaactttcgagagaagcggaatgcgtcaaactgtagtgggttttcgtagttttccgggtccagatgaatattctgcgtcgggaaggccattcggacgccgggcccgacacggagtccatccccgacgtcaagttcaccggagagaacgtcgcggaagagatttgtaacagatacgcctgacatgcgcatcgactcccgcagggctgagtcggcgcgaaacagttgattgatgttctcgctgctggcgagtccgcccggctgcgaggacacacgcctgcattcatcctcgaggcccgctaacacctctgcgctgtcggggctgccgaggatgtcgaacacacagtgtgcgaagacaaagcaaatagcatatatgagcgggatgagtatactgactagacgtagcgcaatgcggcgaggttcaagctggctggatccctcgctggcacaaattggaatcatccactgaaggaagtcctcctagaagcagcggaaatcgtttgtcagtgtttgattctttgaggaaagccaaactaggcagagggcgaaattgcttgatcgaaaaggcagacttactggaccagaattcttgtccgcctcccaaatgcgaatgcgctcctccactacgggtaggagtatcttcacaaattttgcttggtaatacttcgcccgcagtgcaaccaatggaccaaggagccatcgtaccgataatggaatgcagttgatgatggcaccgccgactaggagcgaggtcgcatattgacgcgacgtttctaacagagccggatcgcggctcaggggcaagccgaagagcatgcgctgagatgagcgagcgatgattcggccacacccttcccagccattgatctctttccactctttatcgactccccagatgtctttaaaggacaactcaagctcttcagctgttgtaggggcaagccggctcatgtcgcggctttgcatttttcgccggacgacctcgaattgcagaacattgaggtaaacatcaggatccgcaactacgtagggtagttgaacgttctcgactagaccatgtaggttgatccacgtagcttcattcgtcttgtctgggcgcaagagtagcggtatcttcgacggcggcaggatcatcagggcgccactacgtacccacggtgtgggcagagcaaacggccgtcctaaagctcggttgaacttgagatagccgtcgttggctagctcagggaccgacgtgatgggacaagatctaatgattgccttaagggaaaccatcttctgcgcgaacgtatcgccggcgatgtctagcttggtccatattttcgacgagctttcgtagacagaatccttcctacctagcaagcgccaggtagcaagaccaaatccacatacagcgaagaagacaaggtactgtgttgaagaaatcatgatcatgatgatgtagctgatgatgtagaggttgagggataagttggagggttcaaccaaacctgaataagagcactgcgctctgtcctttggcttgatttgcagctttactctgacttcttttttccgtcttggtattggcatacaagtctagcccttttccaggacacgcagaggttaccgtggtagaaccaatgctacggtgtctgtggagtaaggggttgttgtctttggggatttgtcctcgagactttgtccttgggactttgtctttgggactttagggtgtggtgtggtgggatggggggtttcccaaaggatgcagatacacgaagcactcctcctcacggctccatgtagatgtggatcaacatagcccatcgagtcacgcgctaggcgacgaatccatcggaacaaatccaaaactgacgacagataggtgctcggccaattcatggctcgcttgagcggggttaataaggtccgattcgtccccgttggctgcaggtttggtaacatgcattgaacttggtagcctggtaatacttctcatactcgtactcggtaatactacccaaccaacacaattgtacatatgtatctttatgcaattaggagatccaaggatgcgagggtaaacgagcaaatattttcttattgacgaaggttgtgcgatactgcggtttggcacgtcgacctaggctcacaagacacaattttgcaaaatccagtgaagatcatataatggaacaagttaaagatcaagttattttgctcgccaatgagagcgacgccagccgccagaaagtgatgaaagctctccaagacctactcttctcttttgaaactaccgaggatactattcacagatacggacatatggttggtcaattgctacaaacctcacagtcgctccgactaaccagcgataagactcttcaaagtgccgtagtccaagctggaatcaacttgggcctcttcaagtacttgtcacagcatggcaagcccttgacggtcgacgagatatcagagaagtgcaagacggatcgtcagttgatgggtaagttaaaatgtaatatcaaacctggatatgaatctcaatgttggtctagttcgcatcttgagatttctgagtgctgcgggagcagttcacgagaccggaaagcatcagtatgtggcaaatcatgtcacagacaacctcagcgacggagctgtcgaggctgggatatcacactagtaagtttgacctatgagctcgtcttgtcaacaccgtacttaattataatcagcttcagtacagcctctccgccggcccaatcccttcctgactttctagagcaaattgggtacaccaatccggtggctgaaacccacacagcgttcaaattggcctttaatacagatctgaatgcctacgcctggttcggccaaaatccaacacagttgaatcactttaatacttacatggccctccgccggaaccccgactctacttggttatctgtatatcccgtcgcggaggaagccgctgcttggccatctgagaagcctctatatgtcaacattggaggtggagttggccaccagtgcgcgcagtttcgtgagaaatatcccgacttacctggtcgcattgtgctgcaggatctcccgcattcagtggcacaggcactcccaacaccgggcgttgaaaatatggcccataatattctggagccacaacccgtagttggtatgctatccatagatgccatctttctactttcctctttgctgagttaagctgactcttataccgtgagtaaggcgccaagttctactatctccgggccgtgctacacaaccaccctcctcacacgatcaggttggtggttgaaaacattaaagccgcgatgggtcccgactccgtgctgcttatagacgaaatggtcttccccgagaaggaagtcaatttcaacacagcatctattgacatgactatgctttcagtgtttgcgagcatggaacggaccgaggcacagtggcgcctggtatttgaagatgtgggattggagcttgtacgcacgtacacttactatccaaggaattacgaaagtgttatggacgtgcgactgccacgggccaagtaaaacaagcgaaaacgggactctttctatgaaagaatggctgtgtgtagcaagttctcgttcatctcgaacttggttgttaggggcttggagtgaagaaggaggtagtggagctctagaggttaggtttacggttaaagaggggttagaagaggcttagccaatacttaaggaacctgttacccctgattattctagaggagggtcagaaatcagtgaatagtgacatctatctgcatgttcgaaccagcagtgacccatcatctgccttgctttgtactctatccatcctccttgcgacaaagacctagatattactgaacccgaaatctaaggttcatacgcagatgtggctctagcccaaagcctgctaattttaaggactgtaggacggatactattaattgtgtgatgctgtttagagcttaagatgaatgctggtgctactggataacaaattgacttcacttggaatcagaaggcgcaaaaaatagatggtggtttatttgtagctgattctttggatgcagttttaatcggtattttggttgactggtccctgccacgtgaactccaagatcccaaaagcagatccctctggctcaattacagtctggaatgcaaaaccagaatctgcttttgtaacgagcgacctcagctcagccacagtccgctcttgtccattaaacgccgccgccatgttgagatcagtagccctagaaaagacgttaagaacaattctacgggaaagttgaaatccgcctcacgtacctgatatttttctccttccataatgccaccgtcccgggctcgggcatcagagtttcttgaaccaaaaccttggcacctggcttgagtgcaggcacgagagcttgcagaattttaatacagtatttatcggaccaattgtgaaacatccagcgcagggaatacacgtctgctgctacgcatgactgtggggcgaaaggatcgtggactcttaattgcactctgtcgcgtagatcttctggaatatcgtcgtctcgacctttttgtccatcttgagcaatcaactgtaggttgttgaattttttcgccaaggcgactgacagagctccttgggaaccgatatcgatcacttgagcgtggcccagagactcccagtcatagtagtctgtaatgaatgacagattgaactgaggccgctgagaaaagattgccatgcctcttacccattgaccagctcgctcgttatcctttgcaaaaacactataaatagtgtctccgtcatcgttcgacagcgaatagccctgcaaacatacttgagtgctgttctgaagctcgaggggaaagaacaatcatactgtttcattgggttcctcagatgctggccatttcttaagggcctcggtcatctattgcattgtaatcgtgagctttaacctaactgaagctcactgttctttgactgtactaaccttggtggcagctggccacatctcgcgtgtgccagagtgtagccagtcgttggctgctgaatgactcaaaaccttcgacgcagatgtgtgggcaaccataccaggctctggctcatggaacacccgcatcgtcatagcgtgacgcagaagacgagctatcattcgctccgtcatgggcgtcgcgctcgcgatctccccaaacgacacctggccatttgacgggaccaagtccgcaatcttgaactcagcaattgcccccaagcataccaaattgttatgcttttggtatttcacagtaagtagccattcatatagttttcaatgacaattttacttacgcctccatgcctatgaatcaaattcagtggctctagcaataagtcatggagctctgccgtggcatcaagcaaaatgtctcgatccttggaagtctcaagtggaagatggaaggaggaatcttcgtcaaagctaggtgacggactgccttcagcatcaagcgttttctgaatgctagctactgatttgctaatagcattcgcaagctccacgatgcgagagacaccttcattagaagtcatgctggattgagtactgcaggatatgctaaaagctcaatatgtgatttctgaactgatggtagagtgttgaattttcgacttatgtgggattgtgaatcggatcagggtggatagagaatactggcgactgggattctcgagggcttgccaagtaggtagcagaaacagagggacagccaaatggccccgttatataccgctgtgctaaaaagcagctacaagctatgactttgaaatctatgaaaaatcagaactttatgtaatattaataaaggctatttaataaatataaattttcttagctgcgatcttattgggtagattttatttagaataagcagtttatagatctcaaataagttatattatttaataatacctatttttacattactaacttatatatctatatttttatacaaagttgtaaagttatataagtttataatattccagattatttttagataagttattaaagagtatttaaaaaagaattagtaggtttagggtaagacactataagctggtcgcggactaactgtacctatcagagcctgagtgttaaagtaatgggtataagcatattcatctagaagtaattgtacgaacccaacacagtacatcagcaacaagtacccaaggacttctcagccaggtcctagcccatgcaaagctttcatgtgaccaggccatgttgcagcggacacagaaaggggtagcaactccgtgacatcagcagccggtctgcaacccgagaaccgtatcacatactttcaattgaggcacccaagttgcatgagataacaaaactaaacatatacgccaaagtggggtagatatttcatacaataatttcgcatgaccaagctatgatgcagcggatgcagcggatgcagaaaggggaagcaactccgtgacatcagcagccgatctgcaaccccaggaccgtatcctatacttaaactgaggcccccaagttacatcagcaccaaagggaaaacacgtcagtcaagtgaccgtgcggaacgcatgagagctgcggtaccaaacaattgggaaatcatgttagtccttagtgcgacgtgggcggttgagatgtcatctggactcaacatccacacgcatgtcttaatgataagcaacagagtagcattgcatctcaaaggaatatagaacatggtttctgattaactatgactactacaccaatagaactcttgtgttagattgacacctgtcacaaacacgggttgggttccatcacgaatctggagcgtttgtggctcaagtcccgacatttgaatgaaacatggctgtcagtttacagtagctctccaaacagagccgcaatagaagttttccttctgcctattgccattattctttgttcgacaataagcggttcagccattcgaccctccattctcatacaactctggcggtgaaacctcaagatgaatggaagagactctacttctgtagcttcatgtgctactcttcaagatgttctcagacatcaagcgaggtcgtcctgtcctcgtcgtctgctcttgtatcctctgggaaacacgaaccatgccgtaggcatcacttatgccgacctctattaccaggcgaaatggaatagcttcaaagttcggtcactcgagttcttcaaactcggtcagccactcctgctgcattttgacgaccactgggatactatattgtggttctggtcggtgcttctggctggcggcgtacccgtcatctccacaccattcagcaacgtagaggaagatcgaaatcagcatatcaaggctttatctggtctattggaagcccctctttgctttaccagatctaggctgttgcccctttttggcaaagatcaacatttccgcctgaaaactgttgaaagtctccttgaagaggcacaaattggcccggcccatggcgagagacgtgagtgtgcaggtggagtaagcagccaagcgcagccagataaccaggaaactgttaacgcggcattggatgatgttcagaacctggattccgacgtccgcagccagagcagccaaaaagccgtcactgggagagaaggcagtcgtccaatgatgctcctcttaacatcaggcagtactgggaaggcgaaagccgtcaaattcactcatggccaagtcttggccgcggttgctggcaaagctgctcttcgccctaatccaccagaccagccatttctcaattggatcggccttgaccatgttgctggtctcattgagattcatctactcgcattgtggctcggcgttgaccaggtccatgtcagtgcggctgacattgtgccgtcgccgaggatctttttggatctcctcagtcggcaccgggtctctcggacatttgcgccaaatttcttcctcgcaagactggtttcgaaaattgatgcttcggaagcgacagaaagcgaatgtgatctttctggcttgattggcgtagtgtccggcggcgaggcaaacgatgtcaagacttgtttagcagcatccgccttgttccggaaacttggtgccaggactgaagtcttgattgcaggattcggtatgacagagacgtgtgctgggtctatttacaatggaaagtgccccagctatgatgtcttccagggcaataccgtagcctctcttggaaaatgcatcagtggtgctgaaatgcgaatttattcccctgaaagcacggctggcctggccgggcccggggacgtcggtgacctcgaagtgcgtggtcgagtcgtctttgaggggtattatcgcaatcagaatgctacagacgatgcatttacgactgatggttggtttcgcactggagaccgaggatttgttgatgagaacgggaacctcaatcttgttggccggtccaaggatgtcgtcaatatcaacggcgtcaaaattgcgacaggagatatccaagacggcatcgaacaggccattggggataaagtcgcacggttagttgttttcgcatctaaagccgcccacactgagcgggcgacagttgcattcattcccaaagtgttccctgtaggtgatgatgcagccgcggccattacccggctggcaacgcgggcgtgtctactcaagacagggacttctccgttcgtcttcgcacttctagaaaaatcgataccaaaactttcaatctctaccctgggaaagatatcgcgagtcaaggcggctgccttattcgcaaatggagagtttgaccgtgatatcgagttccatgtgcaatcgatacgccgcgccgcggagaatagccgcattcttgacttgatttgggcttcccaagcagaggctcagctgattgaagaggtcgcggaaactctaaatacaagtgcagaaatgcttgacatccatcccgacacgtgcatcttcgacattggattcacctcaatgcatgtcattaagctgaaatatcgcattgatagacgacttggaatcaactatccggtagttcacatcatgaagaacctatccgtccgctcattggcggccgacatcgacgctcatgtccaccggtccgaacctgttaaccccgagtacaccccggttcattcctacgaccctgttatagtccttcgtccagaaggtataaagacgccgctatggctggtacacccgggcgttggcgaagttcttatttttgtccgactggctcagcacctcgctagtgacaataggcctgtgttcgccctgcgagcagctggtttcgaggccgggcaagacttttttagaagcatcgaagagactgttgaaatatacacagcagcgatttgtaggcgccaaccacatgggccttacgctctggcaggctacagctacggcgccatgctagcattcgagatagcgaagcgattagaaggtgacggcgcagtcgtacgctttctcggctccttcaacttgccaccacacatcaagcatcgaattcgccagttaaactggagtacctgcctactgaatctggcccatttcctcgatctcttagcagaggatgtctcagattcattggtagcaaacaaggccttggaggggctcgctcacgcagcagcaatgcaacaagtcatggagatagctgatacactgcgcctgaaggagttgggattggaccagaaggcgttaatgggttgggtcgatgttgtctatagcctccaaagcatggcaagagactatgacccctccggaaaggttggcagtattgatgtatttcatgctacaccacttcaagccgtgtcaagctcttccgaggaatggatgcgcgagcatttaagcagatgggcggacttcgtgcgcgagccgccgaggttccacggcgttaaaggcgcacactacactatgatcgggcgccagtatgctgaaagctttgcgctgactctgaagaaggctttaaaggcccgagggctgtgaaatcacttctgaatagtcagccatattgcaccaattttttcaacgatgcattgtgttacgaaccagcctgatttgcgcactggtgtgagtggaatacagtcgcagccaaaggagttggtctttaggcgttccatagtctatatacaaagattgataaaggtgactttcgtagatgtgttatagtcaggtgaccacttacccgaagaggtggcaagggaatgtataagacgccagtaatgccactcttgtagcttacacgacgggatagaatagtgccgcatgtccagaggctagggttttcctcgccagcaaagcaatcaacaatagcaagcacttggctcgtgattactgggctcaccgtctagtacggcgagttaagaacgtgcctagtcactaaactacgtttgtttaaacaaagactttggagacgagtaggggttatatctatctgctttgcttcttgcatctcagctccgatcccaatcataatcataacccaacctttaaacgcaagggggggcatctacgctacttagggagaacgtgtcatggtgttggctatgtggttgatggaaggtatcgttgtctatgcggctcttgacatctcttgcttgctgctcctactcaacttgaggcagatgaacggaagagaaagagaatagagtttaacatcattgaagcagccagggcccgacaactcaacgcaatgaatacgaaagcttaaaagaggcagatgaactgcatgacgtatatgaccaggagttaagcgaactgttacgttgcgccttactaagacaccaaattcttgatcacataagaatggatctattcacaatcgattggatatcggccctccaataatccgagtgttacattatacgcatacaccaacttaactaagatcagggtagcagtgtacgcatgcacgacgtcactaaggttagggtaggtacgtgtattcgaagtagaagcgagggggggggcgtgtgtcgcattctacataaaactctttggcatttagccctgggcatttaagctctgcgccctgtcttcgcccgcaatgatcctaaatggccgtaaagctgattcctatggcattatacctagtataaatatcttgttcctttaataggctccacttctggtcattatacacttcagggacatggatacggaaatatcgcaactcgaaaccgatgaagtatgtcggaaatatgggctttcggaaagatctgcttataatgttgtgcgaggccatccctgggataaagtacaagctatgcaggcgaatgtctggtcttccgaaaatcctcaaggcctgtatgtcagatactcatcctgtctatcgttgcctttgtcaaaatacaccttctgaaagtggccaggatatcccttggagtcgccgagaatcctctccttcaacacgaggttggtacatacattaagaacagtgtgagtacgcacgatgagactgaacttcaaattctaatactaaccaggagactagatagctgccaccgacaatgatcacctagggtatggggtaggcccaagaggctctcctcgtctgaggaaggcactcgcctccttcttcaacttggaattcaggtcacatgatcccgtgagagaccgagatgttctaatccttcctggggttatgtccgtacttgattccttgacttggtcgatctgtaatgagggagaagggatcattgtccccctacccttctacacaggcttcaatcccgcggtccaagaacgatcgagaggtgttcttatacaggcatcttttcaatcgcttgagggatatcatagcctagatgatgtcttcagtcctgtgataatccaacaggctctcgaaggtgctctgcagaaagctgcttctaacggcgtgaagattcgggctgttctgatttccaagtacgaccctatcgtgtccaagagctcaatcctatacgcaatatcctgactatcatgatactattagtccccacaatccacttggccgttgctatgtgagaaggccacttgatattggttaatcttcgctaacctaagttactagcccgccgaaacggtgagagaaatcgcccgcttttgtggctcaaacagccttcacttgatcagcgatgagatcttcgccaaatcggtatatgaaaaccctcgcgcttctgatgcgagaccatttacatctgtgatatcgctcaatcttagcgatttgattgctccccatctagtccatgtggcttacggtgcaggtaaagacttctgtgcaagtgggcttcgaatcggagtgctgctctccagaaatgacggcatcatatccgcagtctctagcattaggcaagatgcacattttccatcatctctcacgcgcaggctaccgtaggttgctaaccatttgtagcgtattccaatgggtaccatatctcacacaaaacgcatgggcagaaatgcttgaagatgatcatctcttagctggattccatgcgagaaacgcaaagattctggggcagcattgtgagatcgcacaggcgttcttagaagagcacaaaattccgtattacagaaacgcgtaagtttactactcctcgccatgcaaacacttcactgttaagttgtgctgaaattttgaagtaatgccggtacatttctgtggatagacctccgacgatatttgcagaacaatgacaagcagcaaactgggttgaatctgtcaatttccgggtcaccgcttccaaacgtggagtcgtaccgacatcgcgagagcgagctttgcaaacgttgttttgaattcggtgtggggatttccccaggtagcagcttcagcactgaagagctaggttggtttcgtatctgcttcgcagtcgaaaagcaggccctgtacataggtttacagaggctcctagagtgcttgagggcaatcgaggccggcaacagggaagaaccctagaatcagtctctggatatagggtaggcttatatgtacgtaagagaaaagagaacaaagtttacaactatggggtaggcttatatttataaggattttaaataagtgtgctacccactgacctagaggctttaattctcatttcgcctttagaagaccaccgataagccaattggtcggtgactttcaacagtactcacgttactgatgcagattcggagggaattcagccgcaatgcttgtcagttttatcttcgccgacggacattcagatattgacctctgggaccactatctggaaatacctcggcgctacactgagagtcatcgtgaggccccctcctttcctccatgtttgaagattaagtacagaagtattggcccaaccctgcctacagtgctgaagatgtcggcttccatttggcgagcaccagtaacattgtgagatatggtaccatgtgacgcagaaactccattaatataggttccatttgttcatgtcggggtatgagtgtaccgcatcttgacactggtgacagtgccatcaccaagctcggcaaaatagaccatatcagtgccacgcatgtcgagggggagtgtctgtgggccaaggccgccacaggtcacgacatagcatagcttggcaatgggcgcatgccgtttctcggtgtagggctcaggttctgcattaatcgtggcctggattgaaaactcggtgttagcgctgggcaaagaatgtatgaaaagaaagaaagagggggtaaccgcggcgtagcaggcttagcgggagagtctcttttcttaacagcaagtatgtgttgtgtccacaatgccgtttaattgccctttcaagcaacgtgctgtacccggaagctcactactttcgaaatataagacacttcggatgaaagaacacgggtttttagtagtggtaggagacagatcatgatgatgggtgacaacatcggcggaatttagatggagagaaaacacccaggcaataaacaaggcacggcggaagagtttccatatatgctgggttttcggtgcagaggaattaactcctggacgtgaccgttacaccgtgcgcacatatggaagcaacgtctagtttcttcgtccctagcgtgtgaacgtagaatcctaaaggatcctcatcttctctcaactgcatatgaccccttgatccattttaccttgctagatttctacgttagattgtctaggtagggttgcgatgcatgtgatattgattagggagccccctcaacggtccgatcatccaacaaatgggagtaagagcgctccaacaaaccaatgggtagcatctcatcttagcacttaggctggacaagacagtgagcaggtctttctcaagttgatagaggcaaacgagaggacttttgaacagcccacacggatcgagacagcggcagcatatttgccgagtcctatcgcgggaatccatcttcagcacaggcccacgcatctctttcgatcgggaagcgctagtatccgcagacttccttcagaggctggtagaatgtggcgatatactcggcttaatccaaaatcaaattgcctatcatggaaaattgatttaatcaaattattggttgcagctgcccatataactgcgtctagtatgcccaccatctccaagtgtggttgcagtagataatggcggaggacatattctaatctttcaatcatcgatgtccgctagtagatgggaactcagtcactgggggtgccaggctccagtctttgtttgtccaagtacaccaggcggggttcacagctatcacgctcagtgcctgtgtgtttactctacaccgaaatcactctataggagaacaaatcgggacttattcactcatcggggaggctaaaagttgaacgttcctatgtacacatcccactaaacaacagatgaattgcacatggctcgatgtatagatcttctgtagcatcgtgtgttgtacaatagtgtgtatgtcatagtctcagggaggtgtcaggttaccatatcttttgcagatcttctgaaccgtgctctatgttgccggggatgccgagcgtacggcgcacttgattccgaagtcacggccggtgaatactcgagctttctctggttggtcaggagtttctttggttgttcaacatcctcagatgacaactcatgttcgcactcatttacccacctgcccaatcctccatgtcaacaagctcacgtgtgaccaacaatcattcctagacgccatcccccacccaagacaggcactcttgctgcgaaaatgcttgggtctgtagattaaagacattgtgaagagaccactccgaagctaaccacctcgatacggcccaccgtcaccgtacattcacatgctcccgtacccgccttctaagccgagaaaattacgtgacaatacagtgccaagtagtacagagtcggatccaacaagcagccgctctgtcctaacccaatagcaacatcgtagaacaggatacgaatgggttacttaggctaaagttaggccccccacgtttcactgcaaggatctacaacccttaaaccccgcctcatgactgccgacataatgcaagctgaagctattgcaacatgaatgcatggttctggattacccggaatcagccgccagtataaccttaacttacaacacagacgctcactgcctggttggcaaacccagcgagtctggaaattacatgtgaccgaattgagttgtgctggtccaattggggaagtgcgaagagcagtagggtgcacactgcaagatgttttgggaagtggaatgctccccggagcgtaagggtccttaaaaggtactatggtgcgtagcgtttgatgagtgtacccatgcttgatacaacatgaagcacgctcgatcatgctactcgagacgtctcgtgtcccagttgagagtcagcgcattgataggacgtataaattgttcacgctataccaaaaaaactcttccaagtacgtagattcatatttccgagctctgaaaacagttagacttatgacacgggtctcagaagtgtacacacctcttcccaaaagtaacatggttgaccagagacaagggtgttcttttacaaggcccatcaattgcgactcagaagagagattgtgcatcttcaagagtgcacaccgcacaaaagatgcaattccaaataagtattatctctaggagcttccgagctccggaaatagttagatttgatatgacttggcacgatcttgagagattataaaagaactgcccagtctgaaatagaaaacttcagattttagttgaaacacagaacaatttcttctccacttatctaaagtccaagatcaacaaaaccttacattcgaaatgcatcgatcattcatgggggcgttagcacttgctgccccggcttgtgtcaatgctatgctacgcttctcctgttcagaacttgttatcgatcgtcttgatccgtgagtggccttttgactactaaaagctcagcagactaaactctctgtccaggcttgtacagcctggaatgattccatcgggccatgttcatcaagtcgctggcggggttagtattctatcaagactgtgactagatgtccggtattaacttggtcattctagaatgccttcaacgtcaccatggatccgtcgatccacctgcctgatatttccacttgcaccacttgcactttttcagaggaccacagtaactattggaccgccaatctatactaccgcagccgctctggcaccttgactcgcgttcctcaaatggctaatcaatatcttgacggggccaatggtggcatgactgtttgtaaggggacctgtcggctattgtgtacactcccatgctaatatatatttctgtttagattacattcaaccgtatgacggctctaaagccacggcctttaaaccggtaagccaaacccgtctcaaagtaagtcgtaccaccaatcaagtccgtgctgattcaaaggggtagggctttcgaatgctcgtcggcagcccaatggtccgaggaccctccaattcgaacgatgctcaacaaagcagcttccgctgcttcgaacagaactttggaggggtgaacgctcctcccggtgggggttcggacacgagagacttccccaagcggccctgtccgggaggcatccgcaccaacctgttcttccctacctgctgggatggtgtcaacgttgacagccccgaccacaagagccatgttggtaagtacatccctagtattaattcagaagagcggctgtagattcagttctcattgataatcgatagcctatcctgtgggaggaacctttgagatgaacgcgccgtgcccgagctctcacccagtcaagctgccgcagctgttctacgagattgtgtgggacactcgtcagttcaacaaccagaatgactggcccactgatggctctcagccgttcgtgttcagtttcggcgacactaccgggtacggtcagcacggtgattatatgtttgggtgggagggtgattctttacagagagccatggaccaacaatgcaatgttttctgtggaactctcaaatcccaagatgtgaacactgcgaatcgatgcaccattcccaggcgtgtcaatgagcagattgatcagggtgagttgggttctaatacattcttcttcgtccggtcagcaaaggttactaatgaaatatccaggcttgaccaagctaccaggcagcaaccccatcactccttaaacgtccagagagtgagaattcgagtaccatggttgtcttcagcttttgattcggacttcataatgagtcatagattgttggacgccttggcttgagattatctggggaatagtataggaaaggttagttcttttgataactatatatctatgcgacgcatcctcaaagcgtgtagttcctatacggaaataaactttttaacgatgaagtccctttcctataatatattacttggtagtcgtccagaaagcttaaccagttggtggagagcaagcccaaggcataggttcttaactagctcacggatagccagtgaccacctgtaaagagacaatgcgagtaatatgtatattgtcttttcctattcaaaatatccaacttatatatcgtatcagttctcaaatgtagaatacggtcaatcgaaactgccagaggggagtaacgtttccgttgtttggtatccgacaggtcgggccacgcaactctgcaaagccgacagcaacccatcggaactccgggacctggggctctgatatttcgttaaccggatattgcacagcgtacaatggcgcaactacagcttctataagaggatgaggctcacactaatatagttacatggacgttatttcatttaattttgagaacgtataaatatcgcttttaaattcataatatgctgtgactatgcattcattcatgttttatcctccagaggcgtaagctcgagatgcatgccgttctcaggcttgatagtaataacacctctgggcatcaccaatgcgtcgtccatcgccagtgtccaagagaaagatctcaccatgacagctagcaggcatcgcatctcagccttcgcaaaaccctgtccaatgcaacttcgtggcccgtgcaagaatgtcaggaaatcatagttgctggccgcccctccattcgtattcggcttcccatccgtgatccaacgttctgggaggaattctgcagcattcgggccccagatctttggtgagcgattgatgtaccagatcgagacgatgatatcggtgcccttggggatgaattggtcgccaatgcgcgtatcacagagagcctgccgcatggtcattggcaccgtcgggtagagccgtagtgtctcatgcataattccgttcaggtaagggagttgctccaagattccggcaagatcaactgatggaatgtttccgatatcctctggaaaagcctcagtaacttcctctctgagcttttgttggatttcagagttcttcgtgagcaaataacatgcccacgtgagtgcagaagctgtggtttcatggctgtttcttcgtcagagatataacatataaggagatagttgaaagcgacataccctgctgcaaggaaagtcaatagctgatctttcagcgcctcgtcagagaagttattcgacttgataagaagtgacagaatatcggagtgatcatcctccttctcagtgatagcaaccctcttttcccgaatcattggccgacagatgtcattcaatgacccagtcaagtaattgaaaaggtcgttcatcttccatgggatcagtcgaacaaacggaagaccgagagccaatgacaacatggcgaagacgagcttttcccgggtaggctcaagaagtgcttcgtatattcccgcaagcggatctttcttcttcttgacagcgtcaaacttttggcccaagccagcaatgccaatgatgtcgagggtaaccttgctcgcccaggtgctcagctctataactggcgatccgttggtagtaatgtctttattcagtgcctttgccagtacctcccctctagcccacatcatagggtacagctccttgatatgccgaaaatggaaagcaggcgttgaacttttgcggaggaacttgtgctggtcaccctcgacgatgataagtccatctccaagaatgtgccgcagaaacgagctgattctcttcggtttcgcaaagtcgtagcagttatggacgagaaggtcggctagtagccgagggttcataatgcatatctggtctcggagtacgttgagtgttatcatatcttgatccgggtactgtttcgagaggtccaagaagagatcacccgagggcctgcctttgatgatgagggcgcgatgagcggcactaaggtatgcctacgagagaagaacattaatgtcgactgttgcgctatacatatgcagaagagtgttgttgattaaacgtagagacgaggagaagttggggcgaagtaactcactttcgggcccgggatacggcgaaggggactgaacagtcttggatatagcagcgtccagaagacgagtccaaaggcatagttgatgagcagaattgtcgctacggtggctagatgactttgagtgccgtagtagtcaggaaacagcctgatagctaggaatgactctgctgccgcagcgagggtgaggctggggagactaaaaagctgagctgcaatcgccatactgagtatgctgtaatatagagacggagtgatgtctttacttgtctctcgcacaaaaggacagctctggaggctttcttaagaatgttattgctggcgtcaagttaagattatgtgcaagtctatataacagtccatggttcgagatcctagtagataagcgagcgacaggtaaaacgaccggtcaacttagacccaagtctccgattggaaatgctctgggcagcaccgtgagacgaaaacatcatcaaattcatccacatcgcaaccttaccccagaaacctgaagtgggagcctttaccagtcgacttaccgttacaatggaccataacccctgtcgatgttgatcgaggtacctttctgtaccagcggattttcaagtgattaaatgtcattacgaccattcgagcgcctgggctaatgcaggtcgcaaagggggtccggattgggcttagcatgcgatttcactcactgacagtttccgatgacgtcttttcgctctgcctcggctgcatctcgagcttcctccaccacgtggaaatggcgagcaattacgaaaagaagttacgcgtgtctatcaagaccgacggaggcctggccctgactgagcttccgttgtcgatctactctcatatgtcggcccaattaatttgcttggggttgaattacttccattagctccgagatgaatttttcgcaacctaagctgaaaatgtatagctcactgtgcactccaacggctcggtgatatctggaagagactatgcacatgtaggcatctcacaatttacaagagtatgacttgaatagaggctaccaagactacgtccctacgagacatttcatcgcttcaagctaaattgattatcctccaagccaagcaacacatcaaattatcctctgctacaggaggacagtgcattcgcgttcttttttcaaatggctccaaagatcgtagcaagccttattttaggctgtgccctactaggaggctatgccagtatgtttacaacataccaacatggattcttcgatgcactccgcatctgcacctctgataattccttgctttccccagagccatgtgttctggacatgtcaggctcgataacatcattctcgaagaccataacaggcgtagctcctgtagattcgttaatttacgttctcttagagtttttttctcaagggctgaggagtgaccctggcgccaaaggcatcgatcttgaagcgttgcttgcctttggatacctatctgcccaatttggaggggcatggtacctggtggcacttgaaggcttgaggctgggaaaccggggtacgatcctgagttggtaggttttgcatcttactttgataagcaaagtctgacttgtgacgcaggactgggacattcggcacaatatttcaagcagtcacgatcaccattatcgccccgatttatctaacgctgcagctgctatcctcatcttccgttctgcagctgaattccatcctcgccgacccgtgcgacctcgtcctcttaccagtatccacggtcatatcttacgttctaccgactgttgggctctctcttcctttgctcaatatcctctctcgggaagccaagtacatcgccatcgccctttggcagccttttcccctataccagtccgcggtccagggactgtcacatatcttttgcaggacaagacagggtaaagctcgtaacatagcccacatcaatccccgagagtgcaaaaaggctttgaatcgagcatatagattcatcacgagcctgaccttgagcgtgcacttggttgtgatgggaactcttctcgtatcttctacgaccaaccttgtgccaacaatctcggcgcaccatgttctagctctcacctcgcttactagccctcccactctagtaatgctggatccgcccgtgccagcgaccagttcgcgggagattgtggtatctttcttgcggtgggacgtctattgtacgtgtgcttcgatgcttatttggtccggctatcaactatatgcggtgcagggatctccaagtgttatggcgatggggccgaaggcagtgaagtgggcgttgttgggtggcccaattttcccagccttgatgtttctttgggaacgggatgacatcgtgatggataagttagaactctccaggttgtaccaaaaggaagagtgaagggtatagttttgaaagccagggaagatggagggacgctgataggcgtggagcattctaaattgccaggcgcaagtggccaaatagaactggaatcgcaaatgcaatgacatttgactatcaaattattgcacagaacagtacaagttcacctaatatagcatgtcaagggccactgaagcttgatccaatacctcacagtagctcgggctgggcgaggccatcaatggacgaaggaacgcttgctcgcgcgcccatcgatgctcctcaccccccatgtccatccatccaaccgcagatctaattcctatcgccgagttcattctcttcaaaataatatccgccctctcaagctgggccggcgttgcatatgcgcagtgtgagaccagtctgatggagtgaacgatgatcattgcagcggccccgtcgtatggcatactagtgggcatgccacccgggccgatgtcaccgagagcatatggcacactacagagcatatcctgaatggtttttcccaagtcagcctccagaactgggatacactctgcccagaaggcaccgtagctgccatttgctgaatcgctagccgactgaagcttgctgtggtatagaaccacggtcaacagtaggatgagacgcgcagagcggaccaagatgatgatgcacgctgtctcggcgtcataaaaagtgcttccggatcccattttgcccagagctgtcggcacaccacggccctcaaaattggtttgccagtatgacgcggcctcttcgtcccaggtatagaagtcgtcgagcatttcgaagcattccattaccaataggttctcttcgtccggctctatgctaccttgagatgctgacggagggctgtcagcttgattctgtcgtgtgtcgccctcgatgtattttgctagacgatggcgtattgccagcgtcctcgacatcattgataaggctcggagaagagggtcgaagaggcccatgacagtagctatgccaccggggtcactatagttgtcgtcctcacgcaaaaaggagtagatttgctgtaataagttttttgtcagttgtaatgcagcagcgacgggtgtgacacagagagcctacttactagtcgaagaagagcaagcaaaaagagctctgctcctcttctcgttccgatctgccccggccctcgcttttccaagaggtagaaaagccccggggcatgctcactggcatcacctaagccttctccgctgatatcctggtgaaagattagcggcatgatcactcgtggatgggaggcagatgagacttgccttgtaggtgcagagtagcagaatagtcgcaatcaccctgtcatcaatcgcctgatcatccgacttgatattctgttgtaggctccgaatggcgctaatgtaattccttaatgactgtgtccgaagttcctggcctccgagatggttgtacgcggccatttgagacacgctgagagtggctgtttcgagcatgccatgtttgtaatggtcgtacaggtcgggcaggaagctgaagtggccagggaagccgtcggtatcatcgggggacacgaagcgacggataaagtaaaatagcgacacgttgtcgtacgattcactcggttgtcgaacgatggaaaatggaagttggtctttggtatctaccctaggacgtgctgcttgtgtgcatggtttcggagatacgatcacctgtttctcttcatctgccggtgggcttgctgaggtagatagggctcgtgcagatttggtcctttgcgacgaatgacgaaagtcgaattggtcagtgtatccaagacacggcttcccgtagttgtagcatcgacgacaggtgggtttcatttcatcgcactgccaaaatatctctcatcagcttgtactcaatggctacgagatgcgattattactgtatatcgctcacctttaccttgcgctggcgacatcgcaagcagcctgtgttgaagcgccccggaaagaccattctggctaacaagtggagtcgaattaggatgagtcgataaagtctaggattcttgtggtgagggagctcggagaagatgcagcttacggacaacggagcgtcatagggatccggggaaagctgaaagacaatcacgcaattgcatgctagcgagcgcacgagcacagtcacattgccaaaccccgcaaagtacatgaggttgcatccgagctgaagcaggatcaacatcactagcgtagacaggggtgaggagaggaggagctagaggggaggtccagaacatgtgctgcgcttgtcgagagattagagaacaaatcacttattgatcgttaccttgacttggtttggtttagcttgcgaccgtcttgttcctcggcttgacctactttctcaaggcgttgggtccctcgtcacgatcgagagaaacgaggcttcaacgccgagcagaagaagttcatctaagggaaggatttgctcgtaaaagttgtaaatttgactgttccttccaaactcaaagttatcatagcccacaagcccaccctacaaacatatcaactcaaccactctaaaatctcgcgtctacaaatcagccatgtcttctttactctactcccctgcgattgaacatgtcttacgactgggtcgaattgttttctctcccttcctaacggcccctctactccttacagtcacttatgctcctgaagccgtccgcgatgctcttgctcccattgtcgacaagctccccggccgtgtcgcgtcatccctgaacctagcgacggctcggacagccctgcaaatcttggtcggtctgggcgttcttaggcagatcaacgaaacacttaataccatggcgcacaattcgtggcgcttaacagccagcaaagactggaactggcctgacgaaatcgccgtcgtcactggtggctccagcgggattggcaagagcattgtcgagaagctcgttagtcttggtgttcgcaccgccgtcctggatgtccaagacctaccgggggacctcaaggcgaatcaacgggtctccttttaccgttgtgacgttacttctacagagtccgtggcagaagctgccaacgctgttcgccgcgaactcggacatccatccatcctcatcaataatgccggcatcacgcagccaacacctatcctcaagatgcccgagtcgtttcttcgcagaatcttcggcgtcaatctcatgtctctgtggttcaccacccagcagtttctgccacgcatgatccagttgaataaaggacatgtaatcacggtcgcaagcatcgcatctttcgtcgctctggctactgctgcggactactcggccacaaaagctggagcattggctttccatgaatctctggtatgcgagctgaagcaatattacaaagctccgaatgtcttgacaacggtcgttcatcccaattttgttagaactccccttgttgaggatttcgtggatcgcttggaaggctctggcgttcgcctgctgactcccaaccaaattgccagcgaggtagtcaatcagattagaagcaagcgtggcgggcagcttattattccgaactcggcttccgttatttctggtattcgagggtggccgacgtgggttcaagaactgcttcgcgatgtcattggaaggggagcggtacgccagtagcagggtcgaagaagattattaggtgtcaattatccatgtttattcgacacgagcgtaattctatcatagatctggccccccctcccgcttctttatagacattctgtactcaatttatttgaagaagaggcgtttgagatatctgaaggacgacgaagctgaagctgaacccgtttttgagggcattaacaaaaactctttttgttgcactgggagccaatagacaccatatcaagctcagaataagttataacatgtaccggattttaggacaactcagtatttattagtaataattcttagcggctatcttctagcggctatattcagggttagaaagtatgctgaggctctcaggcgtggtggtatatataggtcgtgaataccccttcgcagcgtctctgtttctgtcttgctcttcacatccacctacaccatatatcccagccacaagattcagcaacttacctaaaggcattcacccacggctcttcatgatggctgttggttctaccttgagggcacctcttatccacctctgggtcctcctgtgcttgccgtgggcgttatctaattttcttttcgatgccaccctctgccttgttccttggacacgcccttcccagaaatggtcactgaaccaggctatccgcatacgcgtagtcaggctattgctgttgtactggtccgtcacgaaggctggagacagactgcacctctgccagggacgagagaagaaccgattcgaagtcattgccccaaggcctctcgagtcgtacaggggagccttggcggatactgccatccagcctatgcaattgggtatgacttggacgccatcacgaccgccccctgctgcgttagttggccccgatattgttgttgccctgcactttcacggaggtggctttgtcattggcaacggccgcgacgaggatactggatatctggctcagactctcatacggcatatgggctgcactcatgtttgcacgccgcagtaccggctctcgagtggcaaaaacggacaatttcctgcgcctattcaggacgctctcacagcatatctctgcctgctcaaaacgaagggcatcccagctagccaaatcatcctgtctggcgattcagcaggagcgaacatggcactcgcactggtgcgatacattcaccagcacggtcagctcgataagattccgctccccaaggcagttaccctttggtcgccttgggtggatgtgggtggtgctctcgagcaagacttgacgcgatcgcccaactacaagacggactatctcaacaggcaattcggcacatggggggcctcaaccatctccgcatatggctcgatcgatccgtcgggcccatatctgtcgcctttacgtcatcccttccaactcaagtcaagccttcctatgtatgtgaatgcgggagaacgtgaggtactttgtgacgatatcaaggagttttgtcaacgctacaggaagcacggatggctggttcacctggatatttccgagggatgcccacacgacatcctattgctagggcctagggttgggtttggcgccgaggcagaggaggcggcaaggtgtgccaaagacttcctatccgagaatgcgggcgttaatcttggtggttatagccgaaagggggctttgtgagcggtgacgcggttccggttcaggtaccacttcgatgacccagttggtctaggcttcagcgagaagccactcatagcataatacattcattcacatggaacctgaataaccgagtattgtctctctttgcaatgacgtgcgcgtcctctcggaatctacaacggtcgatctgaaggtcgccagcggactgccagattaacaaaaggatccttgccacgcaactttggcaggtcgtgaagtggtgggcattgacaccttggtgacaacaactaattttctcgcttggcttgcaagcggatgcctgctcccccaatacacaaagatacttcgaacgactttccccgcagtttcggtatttaggtcccaggtctagtgccaaaagttcccctttgtggtttagcttgcgatctcgattcagttccgccaggcttcgtgaccattgtttccatgcccattgccaattacgcatgtcatcacgcctagggtaccagatcattgtcaggcaatggatatgaccggcaatattgcatgtgatgacccgttctgacatctagagacaagctcaacgcccgacgggaaacaaatcccaccaacacgtccacatatttcgatgttttctcgcaagctaagccgtaaatcgggttcccatacgatgtggcatgataacccagaaagtacgattgcgaggtgccgaggtttcctgcagcacgccagtccgtcgtagccacgaaagcaatggaaatatcaaatcgtggccgacctatggtagcgctcaactgcaacataatttctgcttcgcttatgctagaaagctacctgtttacacgaatatcagaagattcccataacaaattactttggtcaaccgcattgacttgtcatgaacagccagtcggacgaaatgagctctttcgacaaacttgacgacaatctgtcattcgacgtcgtcatcatcggcgcaggcatctccggaatcaacgccgcctaccgcatccaaaccgaaggaccttccgatgtgtcctatgctatcctcgaggctcgagactcaatcgggggcacatgggacttgttcaagtaccccggcattcgatccgactcggacatgttcacttttggcttcccttggaatccatggaaacacaacgaaactctggccgccggcgacaagatcaaagactatatgatcggctccgcaagatcagcaggcatcgatcatcatatctgctacaaacatagtgtttctgaggcccactggcactcggagaaacggatgtgggaattgcaagtggctcggcccggagatgatgcactggtcgtttttcaggcccgatttgtcatactcggcactggctactatgattaccagacgccactccagaccaccatcccgggtatcgagaacttcaaagggaaagtcatacacccgcagttctggcccgaagactacgactacacaaacaagaacgtagttgtcattggaagtggcgctaccgctgtcacaatcgtaccgtccatggcggacaaagcgaaacgtatcactatgctgcaaagaagcccaggttacatttttcccctgccctcaaatagcttccttacggcacttcttttcaccatcttgcctgccagtatggcccactttctcaaccggctcttgtggctcttcaagagctatttcacgacacttctctgcaagtcctgccctgggctggcgagaaagatcatcaaatatatcaccgtcaagcagctcccacctgacgttagctgggaccctcacttcaaaccccgctacaacccatgggagcaacggttctgcgcctgcatgaatggtgactttttcgctgctatccgatcgggcaaggcagatgtggttacagataagatcaagactatcgctgagaagcgcatcgaacttgagtctggagaagcgttgcacccagacgtcattgtcaccgcgacaggtctgaaacttcattttggcggaggcatcaagttcatgatcgacggggaggccttcagcgtggcggacaggtatgcttggagagcggccatgcttcaagatgtcccaaatctactttttgtgacgggctatgagaatgcgtcctggacattgggggcggatgtcagctcacggctctttgttcgcattctcaacaggatgcgagaacggaacgtgactaccgtggtgccgcgaatggttgtatcgaagaacatgccggttaagcccatgatgaccttgacttctacctacttgaagaacgccggtgctgtgtttccaaagggcgggtcagggccatggagccccaagtccaattatttttcagacatggccggggcgaaatggggggacatatctacggacttagagtatttttgacgaacagcgtcggctctatggccatttttttggatgattgagctagaaacgtaaacaattgatatcgtatatctgacagttctcgttttcagaagcatgttccaaacttgattgaagaccgctctcagcatccatagaaatctactctcagtaggcaggcatagtttgaagagtatctcacgaaggactattggagatgctaaactcacatttctttttcctctagtgttcaacaaccgactttgtcaggatccccgtatatcggtcatttctggctgcgcagagaaagagccctacaatccgaggtagctgttgtagatgagtggatgacgtcttcctatcgggtcttggtcaaactcgggcattttggccggcgcggggtatactagctccatatcgcgcggcttgcgagccctgcatacgtcgatgatgtacaatgccaagttaaacagtcatcgtggggttgtcttcgtgcagttcaacaatgtttcctaattgaggaccaccttccgagacgataatagtcgcattctataccactcagctgaccacagaattaggattgattccgctgtcaaatcgctcttatgctcccaacttaggcatagaggctcgagaaactgctaatggcttctttccacatttggaatccacggctagtctggctgtcttcttccatagcacagttatttactcatcaccctgcatctctcagtcccagctacatattaacaacattgtttcactgagatcttttatgaatggcttctttactcacatttcaaatcaacctgtgccagctatcagcacactaaatctcagaatgtctcttctttctgaaccaggttctttgggcaacttgactgttgaagaggaacggaagcttcaagaggcatgggtgcacttactccgactatgcgggactcggagcatcagtcatggagcgccagacaaaagtcaagagtttcttcaaaaccttgacaacaagtctcctgagaacttcaagcaaggcttatgggacacaatccttgcagaccatcctgatgcaaccgttcttcgctttcttcgagcccgtaattgggatgtcgccgaagccgtcaacatgcttgcgtctgcaatcaactggcgcattggacgacgaattaacaccaaccttaacagagaaggagaaagtgtcgggctgaagaagacgctgaccgcggatgaagaagcattcatcaggcagtaccgttctggaaagagctatgtcagagggactgacaaagatgaccgtccagtctacatcatcaaggttcgccttcatgatcctagcaagcagtcagctgccgccatggagacatacgtcctgcacaatattgagatgctcagggtcatgtcgagagagcctcacgataaggtgtgccttatttttgatctaaccggctttggcttgcgaaacatggacttccatgttgtcaagtttctcattcagaccctcgaggctcggtatccagagactcttgggatagtccttgtccacaacgccccattcgtgttttggggtaagtaatgaccatctagcaatcgttctacgtgcgctgatcttattcaacaggtatttggaatgtcatcaaacattggcttccccccataattgcctcaaagattcatttcacaagtggcaacaaaagcttagccaacttcatctctatagccgacctgcagacatgctacggcggtgacgatgcttgggagtacaagttcgttgatccagtgccaggtgagaatcaaaggatgcagtcagaggaggaaaaagtcaagatacaaacagaacgagaccaactggtgaaccagttccatcgattgacggcggagtgggtgtctctggaaccagagttcgacctgggcaagggaaagaatgccgagagacacgtgtcagtgaatcagctcaagctgaacttctggaagctggatcagtacattagggcgacaacatactaccatcgcgtcggtgtgattaacagacacggtgaggttgacttcaaagctgcaaattaatcagcacatgcattagatctgcgtaacaattgaatttcctttcattcagtatatctaagcacaaccgtcatgaattgaatgcgacttcaccacacaaggttgtgcaatgagtataacagggacactagcaatctaaatggctctttgtgtgtagatcagtcaaagcgtgagctgatgctagaaatttgcggcgtcactgccacactatcactctggtaagcttcctaccatcaatttattctccaagaaccgctttgaactaacacgagctcgttatcacccttagggtgttccagactcttaaaaaatgcggggcgagtcaccttttgtcacgccaaaagcgcgcgagatcgtgtaaaggtggtcgtagccctaacttggccttggatggtgacctgtaccaaatacgagatagcttgcgagctgcatggaggcaaccccatgtcaacaagcataaggatcaaccacatactaccaatccaagctagatctccctccccgcgttcttggccgagacatttatggagctcaaggaacgaaacgtggggaagtggggggaattggcaggagtcttctcaagtgctaattggattgcagtgattgggttaaatgtaaggacgtgtataagcaataatgactatagcccacctcagcaacatcggtcttcttccaccttcgcagcagccctcccgcaacaatgcggttctaccagttactcgtcacggcattggcgccgctcagtcttgcagctcaggacacgcccaagaccgtcccgcgaactgagctggagctcgtcgagctcctgtcaaagcacaatctcgcgctcgttcctcgatcggagctcacagatgcgctgaaagagttcaacgtgctactcaaaagcaaccagctgcaccggtcgccagttttgatcaaacgccaaaacaatagcacgaccagctcagactccagcggacttctctcaatccctggcctagatgatctgggcaatgctatcagcggtctcatcagcaccctgggagatctgccgggcctgctgaaagcgctccagggcttactcacatctgagttccttcaggcgtttcatgatgccatggtctacctcgctgaaaccttgaagccgcccgctcccacccagatcagggcgcttctggatttagtatccaaattgaacctcgaaggtctcgtcaatgagatttcagacatcgatcttccaggaatagtcaacaaagtgttaaagcttctaacggacggaaacctcgacaacattgacagattgctgtcgaatggcgccgcccttctgacatcgagctttgtgaatgagacccagtcacttatcggcaacgtttcacccttactcactgagctgtctcccttgatcaaaaagattacagggcttgatctcgatggcattctcgacgccttgggtcctttgctcaagaaggatgcgattgaaggcgttgttgagctggtcgacagcgcgcaaaccttgctctcgcccacctttgtcaaccagactcagtctcttgttgccgatgtatcacctctgctaggcgacctgaagcctttgctccaaaagcttacagaccttgatctcgaaggagttcttgatgcgttaaatccgttgctcaagaaagactcaatcgaggatattgtttccttggtcaagaacgctgggaccctactgtcacctaactttgtcaaccaaacacaatccctcatcgagaacattgaccctattctcggcgacatctcaccactcttgaaagaaattacgaagcttgaccttgagggacttttgcaagcacttcagccactacttaccgaggactcggttaaaggaattgtgagcctggtgaagaatgccggtgatctcctgaccgcggatttcgtcgatgagatccaaaaactcatcaaagacattgcacccttactctcagatctttctccgttcctgaaagagctcgtcaaattgaattttgaagagatcttaacagcagtgaagccgcttctcacaggggactcgattgacgggattgtgagcctactgaaaaacgcagagggcctcttgacgcccacatttgtcaacgaaacgcaagcccttgtcggtagcgcttcgccattgcttaataagctgtctgatattgacattgagggcgtattagatgccttgagccctattctcaataaggagaatatacaggggatcgtggggcttttgaagaatgcagagtcactcttgacggaagacattgtcgggagcatcaagtcactactgtccaacgctgcgccattgatcgataagctctctgacattgatctgacgggagtcctcgatgcccttggaccaattttaaccaagacctctattcaaggcattgttgagctgttggcaaatgctgagtctttgttaacaaaggatatggtcgagagcatcaagtcgctgctgtcaagcgctgcgccattgatcgataagctctccgacattgatctgatgggaatcctcgatgcccttgaaccaattttaaccaagacctctattcaaggcattgttgagctgttggaaaacgctgagtctttgttaacaaaggatatggtcgagagcatcaagtcactacttacaagcgcttctccgttgatcaacagcttttcagacatcgaccttcagggactgttgagcgccctgtcgcccctcctgaccaaggagtctatcaatggcctattcaagctcctggcgaacgccgagtcgttgctaacagaagatgttgtcaagagcattaagtctctcctgacaaatgcaagtccgcttatcgctagcttaggcggcctcgaccttcaaggaattcttgaggcattagcgccactcctgactaaagactcgatcaaaggcttggtaacgcttctcagcaatgccgaaaatctcttggcagcagactttgtgtctcaagtcaaatccctcatttcaaaggccgtcgcgcttctagaaggtctcgataaggctggcctccagggcttgcttgatcaagtcggcccactattgaatgagatcagcaaattggatctcgccagtttgctgagcgccgtgcgcccgctgcttaccgaagaatcaattactggcattattggcctcctcggcaatacggaagatctcctcaccaaagatttcgtttcacaaacgaagtctctaatctcaaatgcctcgccacttcttgccagcctgagtgatgctggcctggccgagctgcttggccaggctggccctctcctcgaggagatcagcaagttgaatctcgccagtttgctgagtgccgtgagccccttgctcaccgaggaatcaatcaacggcatcattagccttctcggcaatgctgaatcccttctgagtcagacatttgtatctcaagttggagagctcattggggacgcaacacctgtaagtacagtcatgctattttggattcgatctttgactcactgacttctctagctcgtcgcgactgtggcggaccttgtccatgccgtgcttaagcagttgatgggcaaaacctaatactagtataagaggaaatagtggcaataacgacctggacaaagtacaatgagcagtttattaatatagattcgatatatttagtacacgatacccctacggcaaattactagtgtttgataagtaattaattgaaaaatgtttgaatgtattaccctagacccgtgcttccacctttaccaaagacctagtatttcacaatagatgaaatctatgtgattcatagcgtcgtgcctttcagaagttagaaattgataatgaaagcagtattctcgatctgctaaaggtttctggccagcgtctatcaggaaaatttcgctaagggagttgatttgacgtgaataatttattatgggtcaatgcctcggtttgtacgaagaaagctaggttgcaataactcgcaagctaagctttttagggctcttgcagcaggtttcttggctacggtttccggcaccagcacgtgatggagtcaagaggcttcgtggtagctctggtttatcacacccgtttgggtctggagtcttgtgatcagctttcgtatctgattccccctgttcgttagcgggggaaccccgcccagtgatccgcggatctcttccgcccccagtatgtgcaaggtagaccttaactattctaaatgaagccttcattattatccttgtaacgttagtgtaactgtgaggatgagtagtgttttccttttagtatttggtggggagttggcacggcccactacctacttatccttgctcttgctctctatctttcaactttcaagcaatcgccccttggcaccacaggttttggttgccacttcacagaacataattcactcttgccctttgttaggtgtagggtccgttcaaaatgacagagaaggagagcactgccgcaggcgggcgttcttcacctgggcagaggagaggtagcacacatagcgctccggttcaggacgctcagagctatgacgcttcactcgaagaccatgtttatgacaagaaggctagtcctgtcaatagcaaaagagagaaggtcaagcggcatttcaagcgctggaagtggtggtacctgttggcatttattattttgctcgccattctactcccgttactgtaagtcccaaagccacaggctaacagcctattaggggcattctctaaccacgagccacgccagattcaaggtcatcattccagcaataattcagaacatcctcaatggccagaagctgccaatagacggcggcgctctccaggcgctttcgccaacgcacgttaacatgagccttcttacgtccctaaccacgccgctgggagtgaaacttgaccctgtggacctctacctgtataacaaggaaacgaaacctgtctctccattcttcaagcttcgtctcccagagctgcacatcaatcatcgaacggacgttctcgtgacgaaccagactctattggtgactaacgaaactgaactcctcatttggttcaatcagttctttgaccggcccaaggtggagctatccctcaagggagacccaaacattttcctcggtattctgaagtacaagcgccaccttgacaaggccatcgaggtgccatccctaaattatctcgacggttttggcctcgtggacctggatttcaggctcaggtcaaatgacacaaacttcaatatgaaaggcaatctcaacatcccaaattctggagtactcacacttggactcggtaacttgacattcaacttggagtctgggccaaccagactcggcttggttcatctgtatgacgttcaactcaggcccggaaacaacactgtgccatttgacgggaatttcttctttgacgagctggtaccgaacctgtcagaggtccttgatagccagaaggagtggctaagcaatggctacttcaaattcaacgccactgggaactcaactattgtcaacggccagcacgttaagtacattgagggagttctgaaccagaagtatatcgggttcacagtcccggtcatcagtctgctaagcgatgttgttggtggcctattgggagtaggccaaggttctcttctggaaattttcggtggagctcttggaaactctactctatttgaacagttactaggacattggggagacgggaatcaggcaagtaatagtacaacctcacgaagcatactaaagagaagcaatggtaaaaggccatggatgtataatcttttgaagctaggattaaggaataaggggagataaagagagaattgattttaagtatgtctttaagtttttaaatagttttctaatacatcaccaccacatcaggtaaattgtgggcagccgccataacacagatgcgtataacacgggcacattatgagtcacttttccctaaacaaactccctacccaagctttgatttgcgtttgacgaccgtggctcacttattttagacttcgcgaaagtctgactgcccattcctttgacattcgcgatcaaaagtggcttggtaaacccacggtgtttaacgcagtaatcccgcttgtggtcagcagcggactagcgcagcaatcaatctattgctcagatgagcttagcgaattcattcgctatagaaaatgacgatattgctactcttgttaaattaaaatttcagtgaaagttggtttcctcttcttttccaactttcacctcgtctctaccaaagtaggccctcttaagatcctctcgagcatgcctactgcttccaagccggagagaagcactatgaactcttcaccaccacatacgttggcgcaaattatcacggccgttgcgcctttaccaacccatttcaaccccagcatcttgccgggtccatacgatgaggtggtagaggttgaagactctccgacaccacgaccagccagtccagaaagccaattgctgcgtgacagaataaagcctgtattatctattggcgttgggggcatagcccagcatctctttatcgaggcgttgtctaccggtgcaatgaatacatgagagctcattcctcctcctgaaatagtgggcagtctccagtttatggccgtggcatctacggccagtcgggccgttcagaattcaaacatgaacaccggaaaccattcgaagtaccggacgggatactagtgcagctataaaagcctattttgagttacaaaataaatagatacattagctccattcattccgttggtgcttctggattatcccgattttctctcagttgaataatctcgccaaaccctgcctatcctcttccgctgtcccgggcttgtgccaaccaatccccgacattgtcaacccgccttcaaaatctgtgatccaagcattgttatccttgtctatcaagacgctttctgcgctagcaacgccccatataacgccgttgctatgcagcgtgtccagtggccagttcaggggagctcttggcggcccggcctccgaaagcacacccctgttgtcagtccaagtgaacagcattcctacaacgctatcggcctccattacgacgccgtgcaggcgacagctgtatgtccccggaaaagggggtttctgggcctggatgactttctttagcacattaagttgcttccttgcgagcactcggtggtatatgcattcgaacttcctgtagaagcagtcgacatgctggctatcgtggtcctttataatgggagtttgatcaaggtatcttcgggccgatcgtagcatagttgaacgtcagatggagcaaagcatcgagtcgaccgatcaagctcggctagaaagtcactgtccaccataacgaggggaagcatccagccaggttccttggtgtcaagcttcttgggctgcagctcatcatctacggcagcgagcttgcagacatagttcggttgcggggataggtattgagccagagttggtcgctcgacgacggaggggtccgaggatgctattagtggaagaattaagggcttaaaagctcgaagcagccagtcatgcacatccacctcgctggaatcgaattcttcttcgcggtacatgtttacttccagacaccttaaatattgctgcgtgatgagatagtcgttccttcgggccctttgtctaataccgatatacttcttacagaaactaacgcgtttccgagcgacttctcggggctggaccagcaggattataatagccctgttcctacccccttatctctagagcccaaatcgtcgggctttttaagtgctgcaaatacgataactatatcggataatgtttgctatagcgctggggttaatgataaatgtacagggggccttcttagctactcagctcagttcttaattaataagctaacctaaaatcaacttgaggctaggtacagccattgctggtattgaaccttatgtacggccagacacaaaccccgaagccgggcaaaaaggctagagtttaatatgttgtgatactaggtatggtgtcaagttgttaaattcttggtgtttgggaattcgccnnnnnnccccccctttttttttaattaagcagctgccgtataactgcatagctctctcacttaatgaaatcaacttgaacgtagagctggaaaaccttcgctaaggctccgaatttccaggtggattcagctacctcttcgtcgataatagctatatccttagaccttctcgattatgttagatgtctgctattaaagctatactgtataatatccctgcttagaaaagaggactacttttgcattatgagttgccctttgcttattcaaggaaaaagaccgactagtaaaatactaataatatagattccgagttcatagctggagatataggggttaacacggaatacatttagtagataacccttgtgcaggtgggataggttgtaacctctctgactataagcatccaggccaatgtaaatggtctcggaactgataacaataaccttttcgatgtatttaatacgtccggctggggaacaatatacacttattctatttttttttttttgggggggtttttgccgtatgcaaggggtgatatcccaagatcaggccacacgtgacacaatccacacgattagtttttaaccaagttccggtccgtacccaaccttcaactctatttttttttacttttcattatacagccagctaaggcacaggcaacagcaactccaaaaactctaagaagggcttgtcaagtatataacttggccatgggccccaaagggggacgctcatcatccacaatcaaccacaacacctctccaagctcattatcgccaaccacctctccttgcgacttatcgccaaccacctctcacaacagcgataatggatgcctccgacacttattctatattagtggcaagtgtgatctcatcatctaccctgtcactagccattgagtttaatccacatctctctcctcaactgctgtgtgttcatggcacgcctaaatctctttcctgttggtaatttgatagatataggatagcatatttattttacctcttttctctgtaattcgaattatggcctggctcttactcttatcttaaggccgcccttgactccctgtgatagatatcgttagtactcatgattgatatatataatatgtgaaagctgaattaccatgttcaaagctgctagtggttcgtattctctctcagtgttggataacaggacgtcaaatctctggaggattgcagcgcttatagcaatatcttcgtaggtagccagggcgcgaccaagacaacttcgaggtccggcgttccacgagtgatactctggacacaagtgtattagtttctcttcatcttgtaagcagggccagatatggcttactaaaaggactatatgagatacactctccattatccttgaaccatctcgatgggttgaacacggcagcgtctctccccaaacttctggcattcttgaaaggacataattttggtagctaacgatgtctcccctgtgccaagttagatactgtcgtgtggcaagctccatattcacaccatactatatcaacgactcactttttaatgtgtcgaggaggcatactgagctcgggcactgcgggaagaacgtcatcctctgctgcctccatttgaccagccggagagacagtgttcaaacgcgcagtttcatcccacattgcattggcaaatcgtagtttctttgaaacgttagttcaaatacggtatgaaaacaggtcaaatgttgagtagcaggcatactggagtatctccgtatttcaggaagccatcggtgaaaccaagttcttcaacctcgtctctgattctgtccgcagctcttaggtgtctattatcgcgatgatgaatctcttttatgagccacgaaatgctatatgcagttgtgtcgcctgttcatgtcaatactggagcttgcaggctcgggaatttgaggaacaaagctcacgtctagctgaaaggaacgcaaaaccctggccaccgagcgtgtaattgtcctgggtcgactgcaggaaaagatctagaatatccactccggcatcaggattaggctggtagctattcttcagtatatcttactaataatatatagggcagtatatagtataggctccagggtaggaggtatagtatagagtagtatagtataaggctagatttttcagatagatctattctaaatactctccctaaacctctatataactatatccttatatagatagattattattaagatctaatataatagttaaatagctatactatttactattttagatagatttattctaaatacttattaggaagaaattctatattatatctattactatttaatttaaatagatttattctaaatacttctctctataactctatattataatctaataataaattagatataatagtttaatatattaaatagtagatattttatatagatctattctaaataatagaattattctatatatttaactaggaatttaaattattttaactttttctaatattttaaataaatttattctaaataactctttttataattctagattataattattatttaatattttaaatagatctattctaaatatatattaactctattatactatttactttagaataatattaaattatatttaaactttaaaaataaaatttatttatttaaaaataactattactattactattatgattattcttatctattatatctttaatatatagtataaatagatagttagtagtaatagatataatatactattaaacttaaggaactactatagctataannnnnnnnnnnnnnnnnnnnnnnnnnnnnnnnnnnnnnnnnnnnnnnnnnttttctttattattatatagtaattaagataagataattagctaaataagagttattaatatataatagttaaataacttatactaaataggaatttagaataagttagaattaaaataattagagtattattcggaataatataatcagattattataagctatataatataaattattattaatatataagtattataaagctagtagtaatagatatatagataatattattaataactattaaaagagtattactatctattaaaataaatatatatatatactaaaggattattaaagcttagtaataatcttagtttatagattataaggattattataagatctaaataattctctcttaattagtaggaaaagcagggttctatatataatctatatatagagtgaaatttataatactctagtacttaataattattattataatctaatatactatatatagtattagtagataatatactagcttaagttaattcagattaagatagctttttaaattaaataaatatctattttagttagtattaataaatagaagagaattaaatagaatagaattattagaaagtttattagatagaaaagttaaattaaataaaaattaaacttataataatatatataaattaatatttatttattaatagttattaaattaatattctatttagaaacaaatatatatatataaatactctagagtattagaagtatattactctttataattctattataaaatttactagaagtattatagagtatactattctatatactctagatattatattagtagatctatatattatctatacagcttattaacttattaaagagatttttatttataataatttaaatctttaatattataaaataaagttaaatattatacttttagtctagatatagatattaatattttaaaactctaataatagaaactatttatatagcttgatatataaataatataaatttaaaacttgaaaacttagtaaaacaggataggcttacaaaacctaggtacctgtacagcagcttgccctccgggccgcgcggacggatacccgaccgcttttagcagcgatattcaatcttgaattctatctcaccaaactttggagttcaacttagcatatgaagaattgctcaatataactaaatagatagatagacgcgataaataataatgattatagagaattctaattcaaggcataaacctagtgtagatgatagccctcgcctcagggtgcgactctggttatgttgaataactggaggtaatatagcttattccagtgctgaccttcgcccagaaaaattctccactatctatctcctacagtagtcgattcatggtctgagcctcctccatcgaatctctacaatcttcagccctcgattgaacctccccatccccgcactgagagagctcctgaagctgttccatccaaaaggcccaacgctgagggctatagccagatgagggaatgttcccagccttgatagccagttcaccaagacctgttaggtctgggtgactgtcatcagtggtaggagttgatggatggttgctggccaagatcggaaggctccatctcgaatgagaaatcaaagaagaaagcgcaaacaatagatggtcaagggggatctctccactctctgggcctatattgagtgatcgtggcacctctagtatctctcggaatagtgagagtgtacatagagcagggccatcatagataccaacagaaatcaatcgtccaagaaacgctcctatattctggtactgctcactagtatacgagcccttctgatagaagcggctactaaactcctcaactagatcttgcgcaaataggggtagatcagaccagaatatacggccgtcagataatgtattgcccttggtgctgccagctggaggggggggagatcccaagttcctcacagcaacgaggtgacatacaaggacatcctgcgattcagaccaggctgtaatattcttccctgcctggatgcatttataccatatatcatgaagatatgacgggaggcttttgacaatagaatccgggaccaaactgaagtgcttagttacagctatgatcaggctctgaacatcgccaacaatgcgttcagggtgaccttctgcaaccattttgtcggtattgtccctcatatgcttggagaatggatcgaggttttgggccgaggatgtcatggcgaaataggtgaatacagtagaagataaagctgataccaccgagggagaagaagagtgtaagggtgaagatataagggtaggtagttgttgggcaaatgataaagaataccgtgattgtctgtctctttatacttctaggttgccctagggctgacttataatttcaaggggaatcctggtctgattatggtaaattcttattagctctattatatccatcaatcacaccacaattgtgtagcacagctatttatatatacccgctttgctgctgtcttgcttgcctgcttgcccgcctacgtgtactgttggtgggtcaggcaccagactgcgccactgtcctgtcgaggttacatcactagcccatgtcagcctaccaataaacaaccaacaataccagtcacgcaaccaacatcaaatcatcgtgtctcctcctcgagccagccttccatgcaccacccccgagttcatcccacctaccaatacacccacacaccctcacactcacacacccgcccttgttccttcttttccgcctaccatataatttcgcaaaatccgggcgagacaagccccgctaaattgagtgcagctgcaaatcgatttcctctgttcacaggttggccacagatcctggcccgtttgaggagcgattctgggatcccttgccggtcgaagaagctcataagtgaaaggagatctgcagccgatggccgttcagaacggacatggtcgaacgtcacttgccacgtcgtcaagatggcgtttgactcgcctccgtcctggcgaaggtcccggcgtaaatcaccgagagcacgactaagaagcctggctcttttgccttcgctctttcggaaatcgtccagatactgctgaacagagctgcgcggcgccctcttttgtatgtaggctgcagcctggctgatggctagcgggataaggtcaagcaccttcacgagatctgctgctacatccacatctgacagcgagtcgactctatttggaacgaccacccttggagcagtgcagggtccaggtggataattaacaatggaacgacttgagtgcttgagtgctttctgttatcctaaattttcccaaagatcgtcctaggtctagatgctacaaagccatgacctctaccagggctcaacttattatttagtaaaagtatactcttaagtattaactctaataagataattatatcctattgcccatagggccagaatagagttagctactaaagaggttgttaggtgactttatccagtggccagagtaagagaacaatgaggcttgatatagtttatagtataggaatatggattgctagaatctctgaaataaaagactaagattgctaatctctttattttaatatattataacctaatgcatctaagagaaggctgttttccatatatattgaatagaattattagaatcaaaggtcaattttatttcttaattagaggtaaatatactgaacttagctatcaagcagctgactaaagctattatccagaatccaatctcacttagctatcaagcagctgactaaagctgttatccagaatccaatctcacttagctatcaagcagctgactaaagctgttatccagaatccaatctcactttgaaagcaaaaaataattaatcccacctcctaaggagccggatttccgcagttggtagcggtgcaatccggatcgttgagagccacggctgcgtggaagatgacggagtacaccttcccggggcagtccacgaacggctgactctcccatgatgtgcctgggaggcctgaagcaggacacgagccgccgccgttattgttatacccgccgggcgcacacgggaaattctgccccggacccgtacccgtgccgagcgagccgcagccatcctgtacatgggcggtcgtgatgacccagccgcccgtagtgctgaagaaggcgcaccatttcgtcgcgtcactcgtgcagggtttcaccataactgacccaacatcagcgccattgttcaggtcgttgttcccggctccttcgtggagcgtgtatggacccgcctgcccactgctcacgtccacgccgtcgatgtaccagccccaacggtttccgttgcagttctgggatttgagcgtggtgacggtgcaaacggtgtggggtgcgcaaccggggggaaccccgaaagccgtctcggtgtcgcaggtgccgccgccgctgggctgacagcagcatatctgaccgccacagccgtcgtcctgtgaagtgcaagtctgcccggaggcgctgcatgcttctgggtttgggttgggagttccagaagagcagtggggagtgcagccgctgggatgacagcaacacacactattgtgcagacccgtgctacaatcagcaatattaccttgaatagggtttccacaggtgccgtcgaacccagaacaaatactggtgccgggttgcaaaatatgctgaacatcgcctgaggggcattgtggcgtgtcaggcggcttgcagcaacatacgtcggcgtagtcgggattggtgtccgaccaccctgggggattcgggacatgttgcagattgcacacggcatcgggcttcgacaggttacacagacccgggcaggactgggtataatccgaggggcagcctgggatttggggaggtggtgggcagcagcaccagctgttacaagaatccttgcaggtgaagtcaaacttgaactgcaatgcccaatttttgtttttattctggatagtctggaggtccgagtatgggggtctcgagtctatggcagcccaacaggtttgagagcttgtctgggcgtggaacgcgatatagacagttgtcgaaccagtacctgagcaggggtttttgctggggtcgctaccgtagaccaatgagaaagggacttcgacgggctgagaggtcaccttggtcgcgaaccctccaggattatcattcgagataggcgacggtgagatctgaaccttgtaatcggcctcaagggtgctgccggatggagcagtggcagcaagtataaaacaaaaacctgtcgtctggtggcattgtccgattgtgacatcaatcgtccccttctgggtgccggaaccggtgttgcccccaaatggattgccgcagtacagcgttccgtggaaggacccttgcgggatactgagaatctcggtacacactggcttcatcgtatcgccattgctattgggaggtccaccacatgccggaggggtcttgccgggaactggatcaatgctagtcccgtcacatacgggagcagtggcgcgtttatgcagaggtgtgtcattataggtataaccctgacagcatgagccagaattagctttcgtgcactgatcaacagccgtcgcacagccaaaaagagcggtgaaaactagaacgagactcctcatgttggaaagccttgcctttggaggcgaagaaaaaaggacaatatagtaagagaggatgattttgatatacgcagacatacggacattcgaaccgatgaaggggtttcctactatttaagagcagtttcgagcctgatgttcattccggcagagtagcggagcagcaacaaatttctcgttaattatgccatggggtcgtcattatccaattctaaatttttggtgttaaatctattttcttgcatattatcaagtcatctgatgagcgaactcaacagccaccacacagacggccttctaagtaattacatctgccggtcgaggcgggtgtttgcagctgcaatgggttacgtcgagctcctgtggagggggactcaccaagcctcctgtgaggctaattcgtggatgatgccataaatcatcttgtgattccaagttcatcatatacaaacctaatccatctgaagtaggtgaaacatgtcgtggcttagtccaaggttagctgatcacagtttggcagatcccttaagtcggccagtccccggcgatctagatttgagccacgtcgcgaacccgcttactttggcaatcccttctggattctaaaaccgctgtcacatgtataaacacacagcaccggtaagtccacagtacagtcttcgactcaatgatatcattgtcgttccatagtactgtgccgcatgctcggagagtgctaaccggccaccccttttcgtcaaatcaaccaccccacccctgtcgcgactgtggctgagggaggcttggtagccgatatcgctttttcttagctaactgctaagtaaattcgaacttccttaccgggtgaccctcaatgtgtatccgtaggtatgttaagtcaacggcaacaccaaaagtcacggctttttcaatgaggctatcgcaagagggctgttacggctatttccttttgattgtggtgtatctaacctatgaattccgaggtggtgagggcacatataatctcttcctgcgtttcttgtgactgtagctgcttatctattgcattccaattatctgactcttcctcctcttcctcttccttccgtacatcatattgttgtgagattatcattatatcgaagtccgtaagggtctcgtgctcggtatcttgtaacagctccaactcgccgcttggcttgacctcctcgtcaggaggcgtttggcaacgtgcttgttgtgccttgcgaggagcctgagttccgggctcgaaggtatcgccaacttgcttgatgtatgcaagcccggttagctgtggtgtttcgagtttggctggggctgttgatgacggaagccgtgcctcgagggcttcgagggaagctgctatttcgtgcgatgaagggtctcgtcgattgcttcgtgttttatcgaggttgagggagccccggggccttccttttccacgaattatcagtggctcgaagggaacatcagccccgggcttgggggcctcccggtgccagtgaggatcgaagtcatctagggataacatgcggttgtggaagagccttgtgtggataaggtgatagcacggaagaccccaagctacagctttttcatatatacagccgttacggctgattagcagatcgcgattaggctttaactccacagcctgatatttatctttgagaatcttcagtgcgtaggataatacttactcgcgaatcagcagataaagagctttgaggtgaaaagttgataatttatgaatctatatcgcttggagattctgaatattcttaatttgatatttccagaattcgttgaagcgatctatgattgtattaaaatctgccttcgaagaccaaaggaaacgctttatctgaccgtggagtaactccacgatcgatgtggttacatgacctaggtgacgataacggttaacgagatagataacgaagcgatccttccaaggataaatccacatatctaagcaataatccactggttttttcggatgttgacgaataaagtcagttagctggctgttaaatatgccctcatctcgtgatctaaccagcttgccccaatcttgaagaaacgcttggaaagaagggtctcgttcaacaacgccgttaactctcttcgcgccgggaaacatgctcttacatttcgcaagaacattcatattaatataccaacggcagagaaggttcaccgagtctttaagagcaggctgactttcgatagcgttgatcagagcgagttcgcgatccgtaacagtaacccgaggcggcgagatttaatgttgttctattatcttaagcaacgctgagagagcccaactgtagctctcctcgacctcgcgatgaaggaagatagaagcaactgtaaaggtcttattcgaactcgttacactacagatattcaaaagcggtatattaaatcgattcgttttataggtgcagtcgagcaggagaatattcggagatcgcttgagcagctgtagcccggccgttggggtgatgagaagtgagataagtcgaccggaaggattacaacgatccttaaagatgaacccttccttgttcaaatgctgatacagatactggataggggtccggccttgtagccggcttttgcgatgctgggctatgatattcgagatatcctttgtaataacgctggtaataacctcaccggcttcttatgccttgctgacctcgctagcgatgaagcgggctatttgaatcggggtcgagccggatgaatacatcgcgatgattttatcttcgtatcgcaaaatcgtctcttttcggaacttcgggaaagcgacctttggagcgannnnnnnnnnnnnnnnnnnnnnnnnnnnnnnnnnnnnnnnnnnnnnnnnnctttggagcgaagggatggttgtgatcggtggtctggccaggttcgataatataggcccctgacccggagcttttaatctacaacctgaaaggacaacatgtcatttgtgttgctgacgatcgcctcttcgttagatgagtgttagggtcagtatagctaacgtatttccttccctttgcacagcttagcattcgtttcttgacgctgcttccgtcgtcaagccaggtggtcttgcggatcgagagggcaaagccgacggttttggcataatcatcgcaagcctgcttagcagcctcggcagaagggaaaactacagaaaatagggtatccattgcagaaaagctatcacgaaaagcttcaagtttggcagagttatcgcgttgcgaagttggctaggttgggcgcgtgttggtgttgactacggatacgcgttgagggtcacccggtaaggaagttcgaatttaattagctattggctaagaaaaagcgatatcggctaccaagcctccctcagccacgatcgtgcaggggtggggtggttgattcgcggaaaaggggtggccggttagcactctcccattttaagagcagtaaaaatttgctgcttaagtagcatgcagcaaattaccctaactaactacggaaattacgtacgctctcatatctccccagatgcatcacagcaaacctcataggcttaaagctgccctggtgatacatcaacccaacggagagcgcgtaccaaactagattaaattgtacaaaagaaaaaggatctcagttgatcaagtcaaaacaccatagtatcttttctccagttacccttccgccagtaatattttcccctgtcgcaactcctcgtccacctgcttatcctcaacgcctcgcttctctctgtcgcgccctctcatctcgagcctttgctcgatcggctcgtgatggggtagctggcgctggggctccctccccgtgcatttgatcaatcaattcgaaaactcgtccccaagtaccagggtctgtaagcccaatgggtgcaaccgtgacatatgtagcgcccgttgcatgagggatctcgttacactcatgaggtttgggaaaggtattttccaggtacgcgccagccaaacagcggaactgattgaacatcaggtctgcagaacttcccgggagatactgcatttgcccggccttagtgtctcctcgaggtgtaaagttgcgaaggttaccccatcctagatgccaacagtaggtcgtcccctgggacttcggtgatcccgtccctgtcgaagtggaattgatcgattccttggcagtgtacatagaggtgtccgatccatatccgtcatgctgtgaagaagtgcgtcggtggtggatgagagcttggtctttggccagcggggttccaggagccccttcatccccgctcgtaaggttgatctgtgtaatagggtctttaaccacccgtttcatcccagaacccgggtcatcaagagcgcgtttgtcgtcaaagatagatgcaagtgagacaaccctgattgtattcgcagcagtcatcttggagcaatctccatctcccttcttttcccactcggtaatccagtccacagggataactcgaggtaggtagacttcctgagggtgatctgtgaagagtcgggccgaagggtaattgatcaataggctaggcgtacctacatctgcatagctagccagaggtccatctagaggagatataataggagccagtaaccccaggccagttatagcaactaatcgcgagcagctgtttctgctctctcggccgtatagtcttctgatattatctccaaagaagggctgtaccggtataaagtccagcgtcaagtttgcaatccccagttcattcgctgcgatgctcatcataaccccgctcacttgatcaagtgaacttctgctgaaaatgttccaagaaacgaacctcagcgtacgcgaaagtcgggtcattatctggctcatgatcagactcttgtccactttacccttgtacctcaaggagatatctcccagtgcgacctctacccccttccacgatctaaccttcatccataagcagaaggtagataaaagaccgcaagagtaagcgttcccttgcgataggatttgggagcaggtagcgatgaaggatgaacagagattcatcttgagattgaaggctgtaaagctcgccaccgcatacccaaaccgacgaggccgaccagttgaccaagtgtccatgaagtcaagaacacattcctttttatcaaatgtgaaggaggcctagtgataccctaaggggtgcttgttgtctctgaagcagaagaaacccgtgataaaacgtcgcccgccgcattccctttgaaagtcctcgagggaagtaaatcctccgttgtgctgccctccaacgatcggtatttccggtggaaatcgcccgcagcttcttgttgccgagtataaaacttctgaactgggctctcgttcctgggtatcgaccaccaagcaatggatcaatcgcccgaaaacatgctctttgccgtacagcatgacatcttgcatcgcagagagttccgaccactcgtgccaatcgtccatggttcttcttgcagtcttggttgtaaagttgaggatgtagacaaggtgttgttcccaggcagctaaccgtcggctgggtcgatcgttccacgatggatttgaccaattgggcatcggttccgggataccgttcaggatcgttctgagttcttcagtcgagtcgatgtcttccaagggaagtgtttgattttgaaggccggcaccgttctcccaatttgtgcgcggttcgtagaagagctcgttatccctcttgatacgggtgagttcccaggtcgcaggtgttccgtttgatacttctgcctcagtaatacactcatagtgtctaaaaggttctagagggctgtgcggcagttctaccacgataatactgactttaggggtactcataatgtagcaggtagttgatcaaatgcagaagaagtggaagatatggttttgcagaagtgtaaaaggagaagaggaggagttgggtgggagtgttggatttttatctgcacgcgttgttgtgcgggaaggagcgtgttgtttgtatacgcacagcctttcaacctccaagtcacctctcgcaccgctttcttttcaacttctctcctttacattacaacttctttcagcttcgtacgttcctgaacacctaccctcttcactgtacgccctcgtattatctttcattcgatcaagttactttctcttcttgggtccgtggaaagaactcgtgtataaaacgccgctgtgccttttaatatgagttcacttcttttcctcctcctcactcgtattgcaggctttctctgactcccgtactctcaggatttattttatcaggccttttccgtaagtaattcctatcaaccagcctggcaagttctcttttctgattcttttgcatccagaatccacttgatcaactgttcaagatatcgatagaccagcccggtgggctcccgcggcgtttgctgcccgatattcgatcgcttatatactaaccgatgagtattaataacttcacaccttctcatcctgtcgaccggggtacacatacggcccgagttccatttaatcagataattaaggcggctgggttcattatttttcataagaatttcgatatctggttctgtactggtaatgcccttgattataacggcaatccagtgtatactgagctgtattatcgcagggattattacagctcaagtcatacaccttttatctataatatcaaactccttctcaaggtaatgtataagggtaaggctattatatatacttataatctaattgatcaagtacagcggtacaattcggtatatataccagctgattatatacacccgcggtcccgattccttaacagcctgatcgtaaacaagtaataattcaaagcttttatcatcgccctctatagatatcaaaacccggctctatgctcgtattatcagcgaaacttcgctagtaatatcaaccagaacaggattcatatcataagcttgttctttagctgttattcactcttggataccttcggtgggaagtacgcaaactgtctcttttatacttatacgaactgtgagtatgagcgagttgactactgcccgtgtaatacgctcgaagagagtactgtagggaatctcttcactggccggcatatacagtttgctaaggctgtttactatcctgagcctctccgactgcagacagctccacgagtaacgaataagtagcctattaactggtataaagatacttatactacccaatctcaacttgatcaatttgtcgaagagctggttttgggcgtagatacccgagttccttatcgcagctgggttcagcagaagctccttgagacctcaccaccactgattcctcgtgtgttcttaactcctcgtcgcgaatattaccgatcccaatccccagggatagctatatcacccttatcacctctttatatcaggaagaaaagccttcttccgatctctctccttcaaggcctcaatctatcacccctaaggcgggtagtcctgcttatcttcgcaagcagatatctgtctccccaactcctgttgcccgacccaagctgagaggcttgggaagcaaacctctttcagtttatacatatgatcaattgtctggcgaggagtcctaatagtctcaggagtcagatttcgcttcttaagccgggactttatttcgttctacagggtttcaaaaggaggattccgataccccttgggaaggtatcgcagatcctgttcctgattggaggtcggatgcccgttcttttcaccttcgcggtaaggagtccagctcttctttcgagggttttgatctcccgcggccaggcttgacacagcctttctcaggtcaactcccgcctgtacttccttcggaggctttatctcgccagccttggaagcttccaactaccgtgctaccgtctattgatgagatgatgtcaaagtcgcctgctcggccaattgatcaggtccagggtgtggttttgcctccggttgtactacctcagggttctcaggtagctgatcggcgccctcttacaagtcctgcttttcctcgtcaagatatcactcaagtccgttcaccttccaagctccgcactccctccaggggttttaaagcaatcaatatccccgttggcaaggatagcataggcaatccagatatatatacttatgataatactattgctgactttatggattagaatcctgctcctatctttcgctcgaggagggatagggctgatacagaggaatctgaagaaaattagggtactagggctgtagggagaatgcttcgttgagttgatcaaatagaactgcgtaagtcctatatattttagttttattcatccgtattaggcctgttgttattatgcaggctaaaattcaaaagttgttgctttctccatttttcttttcagcttcttattggtatatagcttggtttgttatctcttcgtcgtggtgcgcctatcctataagttgcctaattcttgtcgtactcaagtgcttgttgtcttccaagcatcagctttatttaattaatttactcatatcctacagctgtccatagtatatctattagtagcttaaccactgttggaattattatagtgatactgagtattatatatatgatttttatatagtcagagttccgttttcagcaacttaagcgagttccacctatataattttacctgttaattaaatgtaactgattctatagaaacttttattttccttgtttttattgctggttagtagtttgggttggtagtttaggttattaacacgatgcttacacctccactcttactatatccaggctcccttctccctatccatacaataaaatacagacctaagagcgctagcgctgtaaggaaagggaataattcatatgtggaaacattacagagcctggtacagtgtatcttgataaggtattcattttcctgtacttatcggggtcaacctgcattaacaggccccaacctggtatattattcagataatacgtgatctccttctcttcttcgggagtctcaacctatctccccatgtgtgatgattcccgtttgatcaaattgttaataatctctcggaggttagggttacacttgggaaatcgttttacctaaaagactgcgaggcaccttacacatgatcgctgctggaagaaggtaataattctaggaggcacaggctcccttttctttctaagtagcaaggattatgctttactattatagtagcaccaaccgttcacttagctatctatcttgagttcctaacagtcctgaggataatacccttggataccacagtaccagtagttcccttgggggtctcgcgaggagtaggcggtattaacagaaatattgtgagtttaatcaaatgcttctctgtcattcactcctttcagagcaagtgagcatgatcccatctctctccagattcaacttcatattctcttccttgagaaggcgaagactgctgacaagggatatgagcatttcttgcatttggacttagcttactcttatttcttcgaacttgagtcttatcttttccacctctgattcttctttcttctgctgcaccaactgtgcagcctccctttgaaggtcttagaagccaaccctcttctccaccttcgaggactttacttcctcctccttcttcttttgctttcgcaggtaattcataaggtcgatttgatcaattccatcagctccaattcctccaagtatcccagaaggttggttgcttcttggcctgctgatgccgaggtaatactcccgagctataaactcgttactaattctattaccagtatagtcgaagttgcggtttataatcaggaagtattagtatacagctttatcaaccactgcccagagtttcttatattccattctctcgagctctttgtatgtcttcttttccttataggcgatattaaagataaggtcagacggtagggccctgagtaagtattgggactgaatcgtatcagtgctccattcagcagggttaattttctggcaaagaagccgatgagtattgatgaaagtagtaatctgctgttgatcaaatgcaaccactatagcattgagccttcgcagcttttcttcaggtcgaataagctgctcggggttacagctgcagtattatcgtttgagcgcttaaactacttcagaccagtggtcccaactttcaaggataactttaaccctctgcttctcttcctcaataacatagaaaagaagaagcttctttttcatagcagggtcaatattagggtttctgaacttaatgaactcctcaaagctgtccaggaaggaagtgattccgtaaccatcaaattccttagttatctgcaggtcgattccgtttttcatagaacaaagcaggtctttcagtccagcagccaggtctgatccctttggatcagcagctgctttatcgtttggtgtgattttatcgttggctattttatcaattcgagaggttttaataaaacggttcgtactggattttatagtattaattctaaatacttctttttcctttctggcagtccttcctgagcaggatataagaagcaaggttatagtaatatccgtactttttgcaaagagtaatccttagattgaacagaaagttccacagagctgtataagaccagttgatccaatggtctggactatcctggtaaccctgtaagcttgttccctttcctcgggtctgatagctccccgaaccccgatataagattaagaatccgactttcatcgtagattactcttcagttttcccccacactaatctaataggtgggactcaagagatttgatcaagtcagaaatctgacgagaagaaagactggcccgttctcctttctcttttctgcatagaagagaaggaacccttagccgtcggcacttatcataccactctcaagcctcctttctaaattacaaagctccactgggcttccccctggtggttctaagtaatattaatgacctgggaccctcgctctcatcaaatggttctcaccaaatgatctaacggaactagggctagagtagtcctagtagaggtccctggttttagaagaagagtctcaatcgtgctataatctatacttttaaatcctcggcgttggataacaccttaggaagtgcttcctgcttccagagctgcaagagaataatcccctttttgatccgtcagcatcatactaccctcgagaagggtttgatcaactgattgcaatctccacgagtgaccgtatacctgtccattctaccaatttcgcctccaggcgtcagggtcagggtttttgaagccctggctctgatcaggttctaactgcttgtaggcagataacacctgagcacgggtgataagggtcttttccgtgggttagcaatccccggaatatctccttatggccgagaggagggttcgtaggcaaaggacaggtagtcagaaattcccactaggcacgcccaggttcttcttgctctagcagcgtagaagtaccttctcctcagggcaaagtcatccaagagaccaaatagcagttaatcaattagaattccttactttgaggattaggcccgggcgaaaccaccatatgagtgccggtggaattttccaaccaacaacaccacaaccaaagaccgggtgggtccgnccggcttcaatagctgcagcggtccaagggagagctttagcttcaaatccctccttctcaaagagatcctctagctggtcaaggccagcttcggatagcttccttttggagccagttgtatggtcaggctgcttatgataaagccggcgggttgaatcgtcagctaggatacgatatccttgggcccgtgagatctcaaagtgctcaaataagtcagttttaaaataaggaatattcttagcctcaagatattcaaaagcgcctctcatacgtgcctttttaggcgtatcgtgttgcttgccgaccattaggtatgaaaagtatgaggttgtaagggggaaattgctgtgtggagcatattttggtgtctcatcccttatgtcacccacttgctcacttatcatcaatagtgagaacaagcgttgaattgtcgagacactaaagttcagggcagcgagataatgacatgtggtgcagccaggccagtggggttttctcagatcttgttgggtttcaaatcttttctttggtatgaatctcagtcatgcgttgacaatgctcgagcccatatcctgtgaagcctggtattagcgagcgcagcctcaatatacagaatcacagcccgagctggattattaggcctcaatcaaacatcaagcgggtaagactctcgaatggagcagatccaattctgtgcctcagctttcaggtcatacttagagctaggtgtcatcgagtttaacagaaatcaagtagatctagcgagggtttggtcagtcgacgaaacgggttatatcatctcgttggagactaggcaaaagtctatcgagtcaaagagaagtaaatgagcacagattggaaaataacaaagggaagaacagacgagaaagggctcaaggagactgaggtacaatgatcttgaaacccgacaatggcgtactctggagctggtgacaggagcggcggagcctaagccgcaatatggaaattctagcccctcccgatacagaaacactcgcattgctttgcttccccctcgagggaagttaatacggctgtattcatatggtactacgctagttgcggaaggaagcggagaatataattgtcaagcattcacggaaccttttcggtatttgaggcctgcctgtgataaaatgtcgtagaagaagagccggtcgtcggcatgggggtcattctcgagtagccggaaaactctagggccgataggagcgctcaggaagatagacctgcctgtcgagtcaaagatccctgtgatggaaagaggaacttcatctgacgctagctcgagcaggaagctgaactctgacatgccgcgcgcagtagacactcacccaggtccagcatcctttatattttatagtcggtcaatacttagtcagaccgcgcgtttcggcagattctctttacaaaagattcaaagccgatttttccggaattgccctcaagtttacgcctatagggagaggggacctgctagatataggcatagattagcacctctacaatgaaacatgtgtgatatcggctttgtcggcaacgccttcgtacgaagggaatcgaaagtccgatacacgacaaggttatgggctgaagaaagaacatttgtcagaagtgacaaactattatcaagtttcgatgattagaacatactgaagtatataaagcagatgggattttcttggcttttagcacaagagacagacaccaaatcagtttcatcaaccaataaacactccgaaacttaacaaaccctgttcggcaatttcatttcgagcccatcatgcagttctataacatttccgtgttagctgctgccattttctcgacttcggcgatggcctgcaagtgcctgcataccagcaccaaggaccctatccctgaatccaccaagtcttgttgcgaaatcgctggtggcaattatgccggagatgactgtaccatcgactctctgcagaataacaatctctacgactttcgaatttgctgcgcctacaggagcgcccttgaagattgctaggaatgagcacgtggtttaatagggcttggtagagcgacgatttaggagtggatagggataagcacataacctcagagaggagaaggaggctggtttgctcaatttgaagataaatgtcatgcatgatattcagcatttaaagctcagaattgcctgcaacgtggtccaaaacaaaagattcctggcctgcttctaccttcaaatgcgcggtgcgctggtagtgtgaagaaggatgttgatgttcgcttggctttcaagccataatgagcaagctaccatatagcaggatgagtgaagactctagaaataaatcttgtgattttccagtactcttcaaccacttctagtatgtctgtattatttccaagggctccagcccggtagtgtcgttgaagcttccaagattcctaattccatggaccacacacctccttttaaacagtagtgattttaccatctcgttcttatgattgggcttcactagatcatatccaaaaccccgttttgatgagcatatcatcgctttagagaggcattctctaagatgaaacctagtggcctagtttctcccgtgttcctggcgaagcatgtgcttttaatcgcggtcgtgattctggcaaatgatcatatcaacggttaagaaatgccaccatgagtgccaaactcccttcccgggcaggctccactcccacctgttcgagtagtcgctacaagttgttttggtttcatatgtcgaaggttcctgttctgcattggtcgttcctcaactgtatttctgaatttctgacaaagataggcagatatcaaggtgctgattgaaggatacgttgtctagcggctggtcctgatcgcaaatcgggcatcggaccatctcacttgggcaccgggatggttctaagggatttgtctccgagctctctgtggcaagacttgatttcttcttccgtggtgacaattcacggctatcaagattatcacccagctttcgctttccagtcggactggaaggctctttttccttcgcgcccagcaaggagtctggcttagaatgtgtacttttatccgccatgcgctgaaaggctgcgctgagagtgtagtccatgctcacaagctgtgtcaacctgacaccaagcaatcggcagggctggtgcggtttgctagccaatgttgccttgacaaatggaagagaatgctggaagatatcgcgggcgccactgattgctttcggtagcttcgtttgcttcgaatacgactcaaaatcgttcattttgaccttgactgtcagagtctgcccggcacggttgagctcctttagcttcgcttcgacctccttgcacaccgtccgcaagtttctttcaattatgtctggggctgaggtttctttaaaagtgcgctctatgctggcactctttttttgctgttccagtgtggcttgaagttctgttcttccgcatcccaggtacacttcaagcagaaattcaaataaccggtccccaaacaggttcctcaagaattgtcgctgtgcgaaaatgccctcgcatgtgacaatgcctatgctagcgagttggcgatccagggtgtatccaatccctgtcaccttcctcacgggtagatctttgatgaatgccatgatgatatccggttcgttaggtaactgatactggccgtcgggtttgataaacgtggaactgatttttgcgagttggatgttggctgcaatgcctgcggcaactgcgatacctgtctcgtgcctaatttccttgcgcagactctcgaccacatcccacggtttaatgtcgtattcagtgcagtacttcgtgatgttgagataggcctcatctgtgccgcaaatttcgtagccgggatcgtacttctgcattgccttgcagatttgcgccatcacctccctatatcgatcatggttgggcttgacaattgtgaggctggggcacattttcttagcgaccgcgattaccattccagctcggcatccggtctttctggcgatgtaattgcaagccgcaacgacggtatccccaacggcgaagggcacgtctttcaggtcagggcgatcatgctgctcgactgaggcatagaacgcgtcgcaatcgatatgcacgatggactgcgaaagatctcgattatccttgaggcgagcgataactttatcagcatgaacgagttggggcgtagtatctgaaacttgcaggagacgtttcttctccatcagcgcgttgcatttttcggttaacgcctgatctctcttctgctgatgattgaaatacagcgagtctttggaggtttcgtaaacggttctggcgatctgccaccaattggtcagtggttgacacgcatggattggactgttcttgactcttcgtgactgaccttgtcgcgatccacgccttcatagccctttttgatggccgcaaccccaacaaacgatttgaacaaagtcgagtctggttttatggcttgattcaagtctgtcgagggagccatctttgggtaatttgctttgttgatgcggcatgtcgattgccgaagtattgaagattcacggtttctgggtgggaagtgagggagtcgcaattacgtaattcataatattaactaccctatagcacaatgtttcgaaagatggcgaacggcgacgatagcggcaacaagcgtgataagtcaattcttagatgagaaatagtctcaaggctcattgatgggttttcgcagttaaaactagcattgatgtgtgtctagtatgtgagtaatcagttgatgacagggaaggttgagtactaaacagcgagaaccgacgaggcccggaatattctcctttcccacctcagccttagcactttatctagacccaacggtttttttaatgacgatcaaaatcgacgctaaggccaaatatgagagaaatacgaccaactcgtacgatgatggccatcactgccgtgagatatagtgagttgccatggtgtcgtagaatctagaatgctccatggaccacggagactgccgcgagcgagcgttaggcctagttccttacataatacattaaatatagccgtgcccagcttagtgcagcaaggtgcatcgggttattgatcaacaaagtgccaaaacagcggagcgaaaggggctaaattacggatgagcagggtcacacgagcccctctgcccattttcttgcttgcttgccatcgccgatcgatcgaggctcggtggatccctccacggctgcctccagcaagcacctgcccctcgccttcttgggagacgggcacaccctgatcccacatcaccacacaacataaacatgccggattagcgatgacttcgacaaggaggccaggcgtgtccttcttccctcgcgccgacgccgctgtcctgtcctcgcaacatgaatcgcttccagcacgcgaacgcaccgtggggcccatctacgaccctcgcaacttcgacaagcccatcgagccgtggcccctcgcctccggagagactctctaccctcccaaatccgaccggtttgcgcccgcgtctatcccggagaagcccccatgcttgacggagccctacctgcgggctttcctcgcccggaatgagaggctcaggctgtcgatgctctggtactacacccggggcatcctcgacgagcctgaattccgcgctggcctgcaggagaaggttcagcttgcccaagagtcgacgggttgggagttcgccatcgtcggcatcctcgatatcaacttctatatccgcatcgccaccgtgggcgtccccgtctccatccttccacgaggggaaaccctctgtgcgcacactgtgacgcaaccaccgggcgtatggcttccgcctcattcctctctcgtgtgtgtttctataccgtactgatcatcttcttagagtattttcctattgcccaatatgctagaggactggaggttccaaaaatcaccttatgcggagtctggcgggctgcaggcatatgctggtgctcccctgcgtttgcaatgtggcgacggcgaatgtgtcggacttggatccctttgtgttgcgtcaagcactagccaggagcccctaacaaagatacagcagcaaactctcgtccgacttgccgactgggtgtccgctgatattgtgcagtgtgcgagagcaaggcgccaaaaagatcgacgtcgaatgtgggagttggccgccgccgcgcagagagaggtcgatgaaaacagttcccaagcgcccgtctttaagattcttgagaccatctaccccgaggccaccattaccctccagccctcccgcgatgctcagattgacatcgaaggacaagggtctctcccgttgtctgactttgagaacggcttgtgggaggatatcgactatatcgacgactttatcgccaaatcgaaccaacgtgaaccgccctcgacgaaggtggtgcgtgttctcgcttcgccatgcgagagtatatctgggccttcctttttggtcatctcatctcgcgacttccggctcatctttgacgacatcgacttatggtttgttcagctctgcgccaccatgatctcgcaactctggcacaaattattattggaagaggctatggttgccaaggagaagtttcttcgtgggttctcgcatcaactccgaacaccaatccacggaattctcgggtccgtcgagttactggccgaggtattgaagcccaaactccccagtggaaacacgcatccactgtccgacgctgaagaaaaagtccgggctgctgagccctccttgtacctggacaccatcaaaaccgccggaagagatctcatttcgatagtgaacagcatgattactttgaacaggtgggccgacattgccatggccgatcgttgttatgccgtgcataccgtccatgatctggagacggagctgggagacgagatacacaagatgctggttgaagatccccgctacaggtcgtcaatctttttcgaatcgatgaatgatgttcctttcaagatcgacatcggtcttctccgagactgtctgctgccgctagtcatcaacgccatccagaacacgcacgatgggatgattaaggtaaaattaacggcgcacacggatgcaaaggaacttgtcgtcgacatagaggataacggcagagggatccatcctgaggattaccaacggatatttgagccttacgaaaaggttgatgtgcactctggcggtgcaggtttaggcttgacactggcttccaagttcgcgacgcttcttcacggctccatcactttggaatcatccagcattggccgtggctcacatttccgagcgacatttcgcaaagtcgagttttcgcaaacagaaatatcacccccaccacccaagccccagagccttcctttgcaattttatgttaaggaaccatcctctgaggacctttcgctgcacaactgtttctccaactttctcattcggaacggatatacctgctcagaccagaaagaagattgttgcgtgactctccttgatcatttagccgacttgaaacacggcgacacatcacaggttccgcctggtaaggttggagtttgtttaattccaaccacagagaaggaagcttgcttcgagcaagcttccaacgatataatatttctcacaagtcccttttttacgtcaaagatgcattcaaccctcgaagagatcaacagaagattggaaagactcgaaactttgcctgaagacccgcctcaggccagcgctccgccacccgaccagccccagttggaggaaggactcatcgaaaaagaactccctgcacacccgaagccctcagcaatcccgattccagaatcagctgaaccagcacccgaaccggagccagcacccgtagcaccagaggtcctgcccagcccgatacccatcgcagaaacgagggaggccgatctggtaagcgcaccaatcccagcgagagcccccaaacccacgacgttgttagtcgacgacaacgccatcaacctgcgcatcatgcagatgtactgcaccaaaagaggcctcccctacctctgcgcaaaggacggaagagaagcggtccaggcctactccaagcaccaggccgacgctgccgaggggaaggtgagcccaatcgaactcatcttcatggacctccagatgccagtgtgcgatggaattgaggcgacccagacgatccgccagctggaaaaggagaagcagtgggctgagtcgactgtgtttatagtcacgggccaggacagcccggctgatcgaacggccgcggacggcgccggggcccatgagtactatgtaaaacctgtgagcgttgcaaaacttgatttaggcgtggttcggtactttcctgcatttaaggcgaagtgagcatacatacacgagagataattataataagaatacgaatattttctcaatccagtggctcaagaacgactcgcatggcttttaagggtgggagttccggagtcgattttaattattgacaaactgatgattctatgagtctcactgtatgatctacttaggtctctctggcttgttctgacgttgcaactgttcaatcagagtgtgacggccacaacctgtcccctgcccccgctggcctcgttcgtgcctccagtcacaacatacaccgtcttctcatccttgctgagcgcagtggaggttggtcccgcaagcacaatatccccggaatcatcaacaagcacggtttgctttccgtccggggtaactttgaccaggaagtgtgggtgcaggccgatataagccgtcccgtcgcgggccagagaaaagtcgtcgtaagcggcgcctcccggcacggtctcaacacgcgcaatctcttcaatatcgccagcccggtcccccttgtcggtaatcttgacccttccaaagaactgctgggcggagttggtgaagtagaggtagtcgccatgaacatgcagcccgttgatgccgagagggacaggtgcgccggcggagaatcccagcttctcgtcgtggaaggcgatgtcgaaagcgcccgttgccgtgttggtgcggaagatgttgccttcctttgacccagcgtggagcacgatgtacggatgtttgggtagagcggtcatgccgttcagcatggtcgtgttgccacccttggctacggtcttcacagtgggcttgccattcttttcgcacttcttgaagtttatgatggcggtctgggcggttccagcctcccaggcatagttggcaatgtcactgataccgccagtaacggcgaagacatcgtgggcgacttgggcaattcccgtgagtcccgtgatgccgggcacctgggcgatcaactcggccttgggactgtcggcgctggggtccagcgtataggtgctggcgttggcgaaggtgttgaggagaagatggccgttggagcgaattgcgatattctcaatgaaggtcgcttcggggaactggtagagctgtcgcacttgcactgcgccagtcagatgtgcggctccaaggagcagaattgacgggacgaagggggcgagagatggcatggttgactgtgagatatggatatgtgcttcctttcggctgaatgcaggaaacatctgacattccaaagttccttctcgaatcctttatagtgtgagcactccgacccttgtcaaagctattccccgccagccggggtttgaggttggcggtggaggatcagcgtgagtaatacattcatggccctcgatgttcccggacctgcaagtttcctatctccgcccaaattcactgccatgctgacgacaagttaattagttagcctagtctctccaccttgttcgcccttgactcaaaatggaaaatgacgaccttgggccgattttcctaattgagtgttgagctcggagatttcgcattttggcactttgtgatgtggtaagcagatcattagatccggggcatgtctcgtagatgtcgatggcaaatttggacaattcttctctacgatgagctgtttccctctcgatagtcctagtggctacgcagccaagactttctttcagcttcaagctccatggccgatgaccctatgtccgttgatatcgttgaatttattcgttgtgtggggttgtcgggcctggcatctttcatcgctgttttgaactttatatactagaactcgctcacccgatgtcgtcggaatcagaataaactgatggatccccaagtacactcctgatctattaccacagtggattcctcatagagccctctggtacttggggaccgatacagcttcttgccatattggctagcgcgaatgctctggctgacaagaagccaaggtctgctgtgagtatgtgcggtgctgaatctagtcggccctcgatacaccacccctggggccaacgtctctagactgatggtaacccagacaacatgtattgcgagcgcttccgaaggacgaagggagttaaaaactctgacctcctctgactggggtagaatctagtctttgtgcttcatctggaaggtgttttcgcagactacgccactggcgttgacggcattggtcgcagaatcgtcgaagaaggatctgaagcgatacctgcggaacactggcgtttgttccccttgtcgttcgctaatgtgggcgactgaccttgaaagatagtactgcatggtgtcagcagcttggcggttcccgttgagtgcagacagaaagcggcagaaaagcttggtgctgatggcgtcgagtgttggtagagttgccctacgacgaggatcaagggtttgaaacttaagcaaacgtcaacgtgaatgtgagcggtgatagggtcactgcggcggagagcttgaggaaggccgtccttttcctgagcacctccctggcacgacaaagagagtcacacgtaaccatcaacaaaacggcctgatgactttctttctgcctggggcatccactctgatacgcccaccgctcgaaaaagcgcgaagggtcagggcaggcagttgcagtgcaggctggaggtcgcacacagctgtagaccagcgagtagagtacctcgagataggctgtagctggagaagacaggcacaatcctacccgcagtgacttgcgctgtggttcttgcttgtgttttgttttgaagctgcacgcgccaaagtttgcacgcaacccacgtcactcagctttgccatttctccctactaccaacctacgcatactcagctttcttcacacctcacatctcaaccttttttaatttttcttctagctacattctttctgctttccctgccccttccttttcctcgcttcatccttgccctcacttctttgttttcgtcacccgagcactgaattcatttctcagtctgagctcttccactcactccctgtttgctgtcgtgagcttcctcacggcggccggccgaaatggccactccccatgacaaactttggttggagaatatcctccaccatgtcttcctgcctcccaagcttccgggaagcaacgacgagagacagcacgagtgggaaaactcgcttacccttaccttgattaatgctctgaaagactttggcaattttgggtggcgagagtctgacttggcctctattcgattggcagctcaggctctcatcagtttccgaagcttgaactctgcgagctggatgatttcagcgcccgatctcgtggcagtcctcggcaagctcacaagtcaaggtgagttgattgccgctgtcagcgttctttgcttttcagctaactcaaacgtcttgtagactctttggttccactctacattggaccccaaaatgccggcatcattattcgctcgagtgaggagcatctcattttcgaatcatttgagctttctcccgaaaatcagtccgtcttcgccaacaatggccgccttcgaagagactttcccgccgccacggtgtctctaccgcacgatgtgctagaacgaaacgggctcctcagtcgcatttccaccttgattgcagatatgagcaaagtgtctgtaccagagatgcaacccacaatcgtgaaggcgaacgatatacaggctgagaatcgtgacacaacaaagccacacattgtcacccagttactgatggctactttacgagcctttggcgaaatgcgacgcagacgcataatttggaagaacacacgtgaagaagttagatatgagttcggcaacagattgccctggaggcgctcaccggtatggctattgatgcgagtcgtcctacagctgaccctcaccgaccagtcagcaactcctccactcaatgactgcgtgtacaaaaaattcatggtgtacttcatggcacgactcttgaagctctcgttggaggcagatcggcccagtgatgatatttatatcatgaacgctaaaatcactcgccgccttcgaaagcttgacgtcaaacaagctgaaccatggatgacgccggtgtgctccatcataagagatgctacctcaaagttgaatgagcggtggcaagatgttgtgcgacaagacctcaggcgtctcgagactgctgatattttcccctcgtcactcgatcaggaatgcaaactctcgcttcctaagcttgacaatttcatttccaaaatccagcagcgtgcaatcaacatggaacccgatacctttattccctcatccgacataatgcgtgtgtcctcagataaaattccatcgccacctcaagccaagtcaggaccgtatcggatttacaaccttgtggcattcgaaaactgggtagctcagtgcctacccaaatggatcaatagccacctcgacgatgaaagcagctgtgctcagctgctttccaccatgagagattactttgagattgccaaaactgcttacgagtctcaaccggagggccaatctatcatgctcctaatactgctggagctttgggttgcttgtgataagtcagcggtggccatctatccactcttgctagattatgatcctgaggtgccggtagaaatctgctcttcgcttttgcttcgtttccgaagccatatgaaacggttgtctgcgatcgagagacacgtccatgaacgacggcaaaaggctacatacaaacagacttcgattttcaccgcgtttgggacgaaggaaacatttgctgctcggttttatgactcctcctcccatcaccagaaattactggaccgcatcgagtccagagcgaaagaggaggaacttgaaaaacgtctcgagttcaggcaactgaaaaaacagtacgatgcgctcattgcggaagctggacttatgggccaccaagatatcatggtcactgaccgctatggtgacaaatacccgcaacattctaattcctgcaagaagtgttcgttggtcgagcaagctgctaatatggagatccacatccacgaatggcctctacctagcgatgctgtaaaagccaaatcagtcgtatttgagctcgatacaccttccagttttcagcattggcgcgacggtacacatttcctccgcaagtgtgtcctcggaccgttacgtgatttccgcgctcccaaaccggtttattctaaatttctgaacgattaccaggcccttaccagattcaggccgtcgggcaagacatatccccatcaaagggtaatgccagcatcgacaaccaagcccaatgctgtcactcatcgttctgggaagaaaattagtgacgctcgtgaggatgacatatgtcttagaaatgggatgacgtggttctatttcgacacagaggagtatatcttcatcaaaaacatcggcccagatatccgcattgctaaggcttgcacattcctcgttcctccacctctgcaggatttcctacatcggccatgggctaggccggatggcccaggcccaaacaaggtcattgcaagtcaatcgctctgccctgaccacctctcactagatgagttcaaggctctctgttcgctacctttgggccataagattatttgggagaatcttctcagagaatttgcaatgccttcagtagattggcgcaaggttgagactgcactcttcgttttgcaaatatcccaccaaactggccctaggtcttttgattctgatctgagatcatcacatgtgggacttgaagacgaagctttggttcagcagttggtgagcgagatggacaagtcgctgagcagactaaaggaaaactgggaatctattccagcggtggcgaccttgatcatggtaacagcccggctgctttcactcacgaagggcgcttctatcgaaatatgtctctcttttctatcttcttgccggaagacctgtttcaagtggctacaaaccttgcgcgacaaagtcccttcaactcgagatacactttcactgcagagtttgactagacgtattctacaagcagccctagcctgcacgcaatcctatgatattgacgccacctatttggaaatgacgctgagagattctgaagctctgtcacgattcatccagtgttgtgttgcgatccaagaatgctacggtaaacacgaagatactacaaaacaagctgaaagatctttccttgattgcctcattttgagataccgccgtcttttatttcgcacaaagaagatcctgatgagccaaatcacatctcaagaaaacgacggcctcgactctgctatagcgaagatatggccgtcttatagacgctcacgtggggatcaatggacagagcaggcgttatgttggctcaagaccactacctccaaccaagatggcacggtgaaggttcaagttcactacaatgtgatcacagctgaattactcgttaaaggtctgccattgggcagactcccttcaaagtacgaatcccacaaggattacactattttattcggtcgctcgtcagtggacgtgatgccaagtgccgaagcgggtatgaagttttcaactcgatgcagtatccaaggacatcagattcatctatgctacgactctacacgcgatgatcttattgtgcgcgcttgcaaagaagaaaactcatgggagctcgtcccatctcatttgtttgagcaacagtttcctgaacatttcgctaaaaagcatacccactggtacaataccgcaaagggagttgttgaatttcggccacaccaccaaccctggatatcaggcgaatcatcatggacgctccacaggcaggaaggcttgtgggttcttcagcagtctgatacttgtctcgttggcccgttctcgagaactggaaatcagctgcatgaggtgtttcggccccttgagaagcggtctgctttgcacatctttttcgacaaggctgcagcttctcttttgatcaagattcctagacttcaacttgaattttacatgaatgagggatcagaagatatcatgtcccaccaatacagaggcatgcgtgttgatccccaacaatctatcgggacgctcattggacttgacgacaagctggttttggtcaaagtcggggacagccaaaacaggtcggtgctcattccagattggcaaccagattattcaaaatcaccccctgagaatcatgtcagggtcagtttacactactctgctacaagggttcaatcataccagctgaatcatcatctccactgtttgacaggaaatggaagtctaaagagcaagctattccttgcggaactccatgccctgacatctggactcattgaggacccgttcactcttcataccggtactgaggaggcattaataatcttgcgctcagctggcatccactcattctctcttctttccgaagaggagatggcaattctggaaagaattgccacattgtctcctgcccgcaacttctacccagagcagctcaaagtcatgcaggtggtcgattgggacaatcgggggttgagcccaatatcacagcatttagacttcagcagattagtccgcaccttgttcaagcaagcttcagagacatccttcctctacaaggactttgtacaccctccaaaaatacataggcagtgccaagacctagaggatcgcgaagctatcaggtcggctaccttctacagggccggatttggagccgagtggcatacgatagccgaagatgccccctacagcaagactagggatagagatcaagactctgaacgcgcaattcaagtatcggaagtagccgccgctttctgtaagagtccaccccaacttccattccaaatctctcagcatgcggctcgaacaatatacacaaagcttagtggtcttccgatctctcatcccaagcaagccgggccccctaccttatcctttaattctaagtgggttgggaaagtatggcctcgtctcagagaggtgtggggagggatacaaaagactctcgagacgagggatcccgatgaccactttgtactgttttcatggatgatctcggtcgcctttgcgacggatattgacgaatctacgctcagtgtgctactcgggctcatattctgccccgaatatcgtctgatggtctttccacaaaattcttgtttgaacttagaggaaggacatgaatttgatttggcgtggttgagacgctgcatcgaatcgcattatatcgactttgaaataagcactatgcgaaaccaagtggaaacaagagttggagagtcccgaagggacgcgttccagagagtagagtctctttttaagagccagcggaaagagtttgcacgcagtttggaaacccatgtccagcaacagtggcctggtgcgatttcagatccagagaatgctgctgcaggttggacctatctcaacgtctccgaagccatgcaccagatacgagccaggtgtaatagttggcataacaatcacttattccttgaatcattggaagaagtgtgtctcaagctgcgccgcatcactataagcccgaccattgttgggaccgtcgatcggacgccacccctaccagcggcgcgaaacgttcaccgatatattcggatcaatgatctttttgcttctgcaaacacattagaaatttccagcaaagattttgcggtccagccacccaatattgtcatccagaccgaattatccaacgaaggctgtctggtatcggccttggggagtcgggtcgccagtttggccaaattgccccaggaaagccgctacgttgaacagctggctgaaagtattaatcaattgggccagaatatacggcagtctcgtctcacagtcaatggtgaagagttacatcaggttctttccgagtattaccaaagctgcctgacgcagtacaacagtttattggggcagataaagaattcactgtcatggtcagtctcctataaggacaatatgtcttccatgcacatggctgaaggcacggtaatatggccttgcgtatcacccaggaatcttcttgagcagctgaacagacagaattgggggaatctatcggagaactggaaagagattgtggcgaaatttgggtcttgtctctcacaacttcaaggcgccgagaggttacttcagctccgcggaaatgagacagatctcatcaaggagttatcgaatctcggacaaagaacatggagccctcttgagtatccagattcactgctactggaagttgaaggcaatctgaggattcgcaaggtccaacaagagattgcagaaataatggaaagccccccagacaacgagaaaaaaaatgccgtcatgcagctgaacatgggagagggcaagtcgtcggtcattgttccaatagtcgctgctgctcttgccaatggttccaacctggtgaggatcattgtcggcaaaccacagtcccgccagatgttcgagatgttggtttctaagctggggggtctgatgggtaggcgtgtctatcacatgcctttttcgagaaacgtaaggcccagtattgaacaagccaaatttttacagcgccattatcaggagtgtcgacgacagggaggtgttctgcttctgcagccggagaacatattgtctttccaattgatggttttggaggcagccatcaagaaagaagtggagttgtcagatactttgcttcagatgaaggcgaatttctttgatgaatactcgagggatatcattgatgaaagcgatgaaaacttttcagtcaaattcgagttgatctacacgattggattgcagaccccaattgattatgcgcctgagaggtgggcgataatccagcaaattcttggtctggttgccaagtacgctgtcaaggcatctcgacaccttcccaagtccgtcgaggtttacatggcgacccagagtaagcgcccgaggattcgcttcttggacaagaacgcatcggatcaagttcttggccttgtggttgatcatttatgccaatacgggcttctcccaggatttccggtatccagactaagcaagcaatctcgggctaatattcgagactacattactaacccaaggccaagccgcgaagtagcttccagcgttgaagggagtgacttctgggccagctcctcccagagccttctgctcattcgagggctatttgctgggtctatccttgatttcgtgttctcgaaaaaaagatggagagtcaactacggccttgacacgacgcgggagcccaatactcgactagctgttccttaccgtgccaaggacaacccaagtcaacgttcggagttcagtcagcccgatgttgttatttcactgacctcagtttcttactactacggtggtctcgcggatgaggaactgtttctttccctcagtcatcttttaaagtctgaccaggcagacggggagtaccagagttgggtacagtcaatcgaaaacctcccggaggcatttagacagctagagggcgtcaatattactgaccggcagctttgcatcaatcaactattcccccaccttcggtacgcgaaaggtgtgattgattactttcttgccaaaattgtgctcaccaaagagatgaaagagttccctcataaactctcagcctcaggatgggacttgggccgtatcaagaagctacccgccactgggttcagcggcacaaatgactcgcagcatgtgttgcccttgaccgtgaagcagcttgaccttcctgcacaaaagcacacgaatgcacttgtgctagataacttgatgcgacccgaaaactcagtcaccctcctgtctacacaagacagccatagcgcagtttggagcgccatgcagctactggaattgacagtgaagatgaacccggagattcgcgtaatccttgacgtgggagcgcagatcattgacctcagcaataaagacgtggccaaagcttggctcaatctggttcaagctaaacaagatatccaggcggtggtcttttgcgatgacgaagacgagttgtctgtcttggatagacaaggccacattgaacggcttcagacatcaccttttgcgaagcatcttgatgcgtgcttggtgtttcttgacgaggcgcatacccgaggtattgatctccgcctgccacaaagttatcgcgctgccgttaccctgggtgcgaatttggtcaaagaccgactggtacaaggtgagtctttgttttctgtaagaggaatctccttccttaggcacgtactgacactctaaagcatgcatgagaatgaggaagcttggccatggtcaatctgtcgtattctatgtacctgaagaaatcgaaacaaaagtccgagcattaagaactgccaacagcgacagtaccgtcgacgacccgataaatgtcttggatgttcttgcttggtccatctcggagacctggatcgatattcgccggtcgtttcctatttgggcaacgcaagggaatacatttgcacgtcaaaacgattattgggagtcaatgtgtcaacctgatggtaagaaagcgatcaacaaagaattagcagcaaagtttctcgaggaggaggcgcaaacgctcgaacggcggtatgggttgcagcctcaggggtccagtttcatcaacggcttggctcagtctcaaaacccaatgctacgagagatctttcaaagatattctgagttcggcaacgtagatttggattcgagctcgttgcaagaggaacaagagagagagttagcgccggagattgaagaggaacgacaaaaagagcgtgcaaagccagcagaacctttaccgcacagggtccaccccgatgtgctggcctttgtgcgtactggagtgatcaaacgctctggcgccgcattccaaccatcgttcgacctattcaaaggcacaagtgccgcgactgagttgcggattgcccagtggccaagcggcctcctgatcacgaaggattttgccatgacagtcaagcccgaaaattctcccgaacactcgcacatggatgactttcttcgaagcgtccaatggattcttacaagctctgtcggagggaagatagttatggtggtgatcagtccctacgaggcgaacgagttgcgaagtgagattgcaaagtcaaagagggtggtgcgtcacttgtatgcagcgagacagaaccaagggattgccccgattgatggtctcgatctgtacacccttcctggcagtacacctcgacacgagattccgaagaaattgatcattgagctcaatctctttgcaggacagctgtactttcgatcattccaagaatacaccgaggtgtgcgactacttgggtctggcctagaaggcagccgaagagggtcaggaggttgcgccggatgggttcattcaacgggcgacggatgacgagacatgcgacttcaccacaagcccagtcaagtttctcaaggccatcatcggcaggatccggttcaactgcgagggtattgagaagacacatcttgggaagagtttggagggagctttgctcacagaagatgatttccgtggtgagctttgaagggcatacgcgccttgcttgaaggctccatgaggtgaacgagaggcgcgagcgcaggtcggatgaggagaatgaatgagctagtgaagctggagtgaatttttttgtatggaactgccatctacgaagttcggattcttgaatttgccatggctttttgtaggttaaatgtttgataattcacaagatttcaaaaccctcgcagaactctgatgtgatgtgaggtgggttgacatggcatcttcagcgagccagcagatacgcttgaaatcatgtgcatcactcaattgaatggccaattggcttcttctatgagagactggcgtttcagattgggctgctgccttgacttgcgccatcctgaaataagtaagaaaagatgatggactgggctaatcaatgctttaggcatccagcaaggcgtatttatccatcttgcctcatccacaccgcaccagcagccattctgcatctcgaacgttgatttattcgactttattcccttgcagcacaactaatcgataatctgggacgtgccggcactcccactcatacagcgacagacagagtatacacaatcatagcgatggacgcctcaaaggagcatggacaagcgctggaccgcctatcgacgagtgcaacgactgatgacgcagtatcaaccgcacgagaaacgttcgaaatgctgagcagacgcatggacgaaagcatgtagaaacagaaagggcaaaaattaaacttgcacagtgtctccaggctcatggcgacttcgacgaggccttgtctctgtcacgggctgtcttgagcaaggcccaggacacattcggcccccgcgatcctgagactttctccgcaatgcatcatctcactgttctgctggcagagcagaggcgcactgctgaatatgagacgactacgaggactcttataaaggatggcgccgacgctctcggcgacgatcatccaattgtcatcaaggcaacggcggcgctaggtctaatgttacggcgccaaagccgtttggaagaggcggaacagttcatgagggacgtgttcgaaaagtccgaaaactcttacggctccaacgacgaaagaactcttgagagaattgatgagcttgcaaggacactcctgcttcgtgggaagatggaggactctgagccggcagtggaagaagcagagttgatgatggaagaagcgctggacgcgagcgagaggctgcttggcgttgacaataccgagacaaattggagacgagccgaattggcctccacgcgacttttcatgggtaaaactgacgaggcgaaggatttgatggagggagcgctcaaaagatatcggggatcgctgggcgaataccatccagacacgatatgggccgaagcattccttgcgaccacagattccgagatccgggatgttgtgaacaagagcgcaaaggcccttcaggatgggctgccgagagtgaacgtcttgataacttcgctcatcgacaattttacagatcagggccgcttcaaggaagcggaaatgctggctcgggccatgctcgaaaccagtcttcgtgctcatggagacgatcatgccgacaccatcgacaaacgagagaaactggcaaccttgcaccagcgcatgggcgatctcgatgggtccagccggcaacgcagaatggctttgcaaagccgccagcgggtctttggccacacgcacactggaacgatcgaggcggtagacctctttgccaacgtgctcaaggatcaggggaagtgggaggccgcagaggccgtctgctgggatttctttgccgtctatccgacgcctgaccagccaaaccattttgccctcgcgctaatgacgacacatgccaccatcttgaaacacttgcagaaatatgaattggcggaaaagatcatgtccgaagttctacggcataggagatcgatgaacgggagccatcacaatcttgccgtctgggcggtggcttggctgggcagtctgtatctcgaacaaggcgcattctcgcaagcagagcctttagtccgggaaacgtacgagagtaagaagcgagtgctcggtgatgagcatgcaggtactctgatcgagggtaggaggctcgttgaaatcatgagtcgtcggaccataaccaacgaggacgtcgcgtttgtcagcgatctttatgaaaaggtggttcggatatttggtaaacagcatgaggagtcaattcttttcgggcagcaactcgctgtactcttgaacaagcaagggaagtttgatgaagctgaggtgctcattgctacgatcgtcgagcgccgtcgatctgtctctggcggccacaatctagccactttatgggtcatcgcgtgccaattaggcatgcttcaggaacatcggaaatacgacgaggcagagcccatagctgaagggctattggcggcaacacggaagattgccggcgaaaaccacctcacctccattcgcgcccagaacacgcttgccattgtcaaattgcaccaaaaggctctagatgatgcagaagctctagcaagagactcgttagaacgtactttgcgggcatatggtaagggtgctcgggagaccaccgagtcagcgtctacccttgccacagcgctcgctgcccaaggcaagtttgacgaggcggagacgttgctgagcacgagctaccgtatgagcaagcgccgtagagggggtgaggatgaagatacagtcgaactgatggaaaatcttgtccatattttgaagaaggctggaaaacatgacgaggcaatgaaatgggcgaggaagctatatgaagcttgtcagcaaacgttgggcgatgaccatcgtgtgactctcagagcacgggaagaggttgaatggctgtgagacgaaaagaaagtgggtggcgaggcagatattatggtgcagcaagttggtgatgacacagcgagggtatttgggaatgagaagtctaatgcggcacaagtggtgaagctattggaccctccagcagtattggcccgaacggtagctgcaggggaaatcctaaatgaagccaaggaagattcgaagggagagtgtcccgatctgattgagatagagaaattatacgttgatatggcattatcggattccaagagttaggattttatctgtatacagattcagaaacctgtatagtggattccaccttcagttacgtatcgattgctgtacgggacgccaagaatacggtgataaggcaaacacagtctctaatagtcgtctgaaatttttggggagtttacacatcgacatcttggtagtggcagggaatggcacagatccaaagtcgcaagccagcatgggagagatgggctggacgccgaaattctccgatacgcgcggtttcaaagcagggactttcggagaaacatcacagagaaaagatgggatgtagtatttccacacgagtgatgctggatatctaatgccggatctatcaatgcgagtacatcaggggaagacgtcatcggagcggcgtaggggctcttgttgaagaacacgtccaggaaagtaatatgaaaggcactgatgaacgcatttactcagaactgatgtatcgtcgtggtcggtaccagacaggtgctccttgaatctgatcaaacctactatcccccttgagcatatgactgatattcccgtctcttgagatcacataagagatttgcacagacattgaattttaggtcattgtctttacatggcacgaccctccttaaaatcatcgaacgcaaaccagagagcaatattaatcttcatattcctatccgacatatctactcaccccccataatcggctatgatgtttcgaatatgcccgtatcactgtgttttagggataatcattgacttgtagtacaatctcttcatcatgtactgggaaatgagccattcaccatccttgcgtgtccaagtctcgtaataatgccctcctccaactccatgaacaccatcgggagtcccgatagctcccacttggtacgtgacagtacagatagtctttatagtatcctggtcaacctgttcaaactccatcgggcccaccatatggatggcttgctgcacgtttctgagctgcaccaaatagttcccaaggtctcgtgctgagggtatggtgctatgagggcccatgtcgtagaatccttgcccatttgcgtcaagaaactccaaggcgcaatcgggagtgaagagagccgcgaaattgtcccattcgtgggtgtctgcaaagcggcaatattgcgcctttttgttttcgatactctgtctgtcttcgtacgcgactcccatgatgtgctgttctgtctttcttatcagttaagaggaaaaatgtttgtggtatgagtatgagtgataaataaagattgatggcggcagacacctcaccttggctatatggttgacagaggtgtgatctagctgaggggtaggtagcaacgaggtagaaacaaggtacgcgtatcacatcccaccatgtgccaggaccctgcaactgctaggggtgtttaactggctcttggattactgacctcgtatttatacctactatcttatctcgaaagcatgtataccgaggtttggctgccgatctcttgaacggaagagtataagcgaccggagtcaactcaagtctcacccattaaccgctctgccacgttgtctgttgtctcttgaacagaaacatcctagagttgcttctgatcatttatttatctgaaatataacaatagcactctgcgatgattcttatcgggctcctcagaagaatgatctctcggaccgttgcgcataaagatacgtacttcagtctactcagtctctcgaatgaagtcgcccccctattcatgatttgccatccaagagtgtcactattctatcgtgcccctcttctttagctactgagagagcagtgtcgccatccgcatctataaaatggatttctgcaccagctgcgagcagaacttctacgacctcgtcgtggccatacttgcatggttccaatagagcagagcgcccgaagatagacagagaattgacattaactcgcttgtcatgcgcgagaagcttcacaacctcggtgtgaccattctttgctgccatatatagcggtgtctcacctagattatccttggtgtccaacggaattggctcttgcatgagcgattcaacaacttccaagttcccttcttttgctgcgacacagaggcgacaaatagagtcccaattcgggtctctaagctcttccgggacgtgtcgacgaaagcattcaagcccgctctcgtccccaagtgctgcagacatggcacacaccttcggggtgatagaggcgatagtttctgcctcttttttccccatgaacattgagacaatgggttcgatccagcgcaagaacaactgggttgagtaagccatggctacagcaagaagaacgtcttcagtaaccacaatgtcatctccgcgtttgtcgaaaaggatctccaacgagtcgaggttgtattgtgcagcagtcttcataacctcctcagtgatctcaatttcatactcgtcgagcaagaaatcgaacactcctacattacatcgagtagctgctatgataagatcttcgttgagtttggcctctgatgatctgttttttagaaggaagtcaagagactgggggtgacttattgctgcaatttcgacgacgtcacttgtgatctgaatctcggaaccatgcctctggataagaagcttgatagagtccgggttcctcgcagcggcttccacagtgctctgtgatattactatcgcatcggcatacttgtctagaagcaattcgaaggaccgtgcgttatactctgctgccagttccaggcattggtcggatatttgaagacttggcccggattggcgaaggagatgagagaaggctactgtgctgttggcagctgcgttgttcacaagctcgtccgtaatctctaactgctcgccaaagtgctggataaacagcgcaatcaacttatcgccgcactttggattgccagcggcttctaagaggatatgttgtgctaccgggaaactttgtttcccaaatttcttcagcaggatttggaggacttgttcgccttttgtagtgtcactagccacggtgctaagggtgttatccgtcaggacaatgtcaccttcgaccttgtcgagtacgaagttcagcagcttgagcacgttgtcgtcggacccgcgagagcaaatgacagattcaatgaactccgttgttatcgcgatcccagtccctcgagtgtcgagaagcagtttcgtcatttcataggcgcaaaacttgtttgcagctgcaccttgcacaaatccttgggttacaggaaactcggagccatattttgccataaaaagcctcaacatttccgtccccttgctccagttcagggaaaacagcaattcgtcagtgaaaggaatcgggatatcgttgtccaaagcccacttgacgatattgattgagccccgttcaacagcaagctcaattggagttttgccatctacgatttcaacaccttttttggtcaagctcttccactcgtggacgctaataacaccacagatgtcgaatatgcaaacaggaagcagaacaaatggcataaggccaaagcaatatgagaactctgtgggaagatccatcctccacttgctgtaagtggtaccgcggaaggcttgatcccataaaccaaacggcgacgaaggattgtcttcatcagacaagaatgagattgtctgtaacaggcgttcgttctctagaagctgctggtatatggaagccccaccagacataagagtaccataatacttcaacggatggttctgtatcgtcttccatgtttatatcgggtgtcgcatccacgatacggatgaggcaagcctccgccacacgggaattgataaaatcggatttgaataattcgtgcgtttccagaaattctcgaacggataagtgcgcaaaacggaacacgtcgagggcttcgtcgaagatgaccaggttgcaacacaagtccagaagctgatctcgagaaatcgcttcactttccccgtcctttcttgtggacacggcagcgagaaatgcctccgaggttagctgggcatggctgcagaggagccagctgagactgttcttggccagatctctgtcggaattcgcttcgaagttttccattttaacaacaagttcttggtagagatctcctaaagtccgaggaagctggcctaatctctccataatggcttcttcgctacggcatttctgaagtgcctgcagttgaagacttacccaacggaacctgtaagttgttagcatcaccatcggaactttagcacccaaataccagtaaagctcttacattccatcagccttagccgtgagttccttgattatcttttcggatagtgcttctctgccactctgggtcttccgtagaaatctattattgagaagcttctttacctctgacgcaacaaacagttcgatgtctgaagagctgtgggccgatgaaagagccagacaagggtaattttcgaactgatacacaatatcttggtcatcccggcttgacacaagaagtttcaaaaggcacggcgattcctccagtaagaattcaaacacctcaagcaggtcacctcgcgtatcttcattgcattcgtccagggcgtcgatggcaatggtcatagtggcgcccttgtattgatcgagaagcttgatgatgagttctttgctctcctcaagtctgagaggcccatcggcagacgcttgtgactctcgttcgttatagacctcgagcgctggttcaagaatagccccgccgacttccggcgtggcgagctgtctggcaatgctggccaagatccgtgaaggatcagatcttccaggctctgccgagttgcgagagcagtagaagtatgccggttgcgggctttgcttcgcctggaaagcgctcatggcgtcctcgattgcgatcgacctaggagaagtttcaaagttagattccagaaacgtaaacttggtttattttcttacattagtttacttttcccggatcccggtatgccgcgaatccacagaatagaagatgcgctttcattcttccacttcaggaagctgggattttcaaggagccactttcccgttcctttcagcacctcgcctttcgtttgtttgtggtgctgtatatagggctcggcagacatccattgcagtactttctttctttgttctcctagatagcgtgttaacccgtttcaagaagttggtttagagaatggccttaccttcgagctggtctgaaatggcatgaagggctccatcccagcgctgcatgggagcatcaaagctctctcggatgcgccgaagttcaacttgagagtccaactgagctgtaaaactgtgagtaaatctgcctactattcatagccaggatcggagacgtaaacttaccctcgaggttcattaccaaagcacaacggctgacaacatcttgggctggtgcgacggccgcaaaactcgattctagatcacctgagacaagaaccccgtacttcaaaattcgttctaaatgttcgttagtctttctcacacaatagcagaagtgttaactgtgccttactaaaagtattttggttgcagtaggcggtcgctcgagagagataagtgaggatggctatgtaaagcttaacaatagctcggctcagctcatctgccgcctgagaggatttccccttaactagactctcgaggacggcagttcgacagatgtactcggcgatttctgctgttgtttcgaacatccccttatatgtgtccaaatccccgacagcgacctagaccccggttagtacctcataggcaagtagttattaagcaacccgggcttaccgtcaacatgaatcgaatacctgcccatgccacaccggcatgtcccggatcaaactgaaccgcaaagtcgcccacctgcttgacgaggttgacccatttggctactttgccgagcacatcacgcacaatcactttctcaccagatgatctcttaaaagaccatgctcgatcagtcaaccacttttttgccttctcagtcaccgataacagctctccaagagtgtctaccttggactcctgtttgaaatctatctgagctttaagctcatctccgacagaatcaacggcagctttccagagattgtccctaacgtaacaagatttcgattagtcagggagcaggcaggaaggtagattgatattacccggagggtctcaccgtcaaggcggcttccatagctcctgatgttgtgagtgtagtctcttgcggtgtttttccgacgacgatgaactgggaaatttgaaaacaggaagtggttatacgggtgggcatcaatgctgacgttgaccgcccctctcactacaaaatacttgcaaggcttgtttacctgcggtctgaacaaggattcacataaacccccacttcagcaggatcaagctctacttggcaagattaaaaataaaaccaaggtattttcaatctggatcttaggtgcaaagaggaccctggcagctagttatcgatgaggttaacgtcaagcttccccgccttatggagagaccagacagataccaagaagtcaacccacaccgaagagggtcgataactgtccgcggaatcaaatccagcaccgcaaagtgtgaccaagttgttgactttctggccagcttatccatcttggagagtctaatgctgatacattaagaaggaccggagagtgggcaaattgctcgcgccatcatgaaccatcgattttgttacgataaagcaagggcaaatacatgacattgatgccatccggatcgtccttcttgatgttgaattgaaacctctcgaccagaagcaacctcttagatacaatggttctttcatgcatgttgtgcccacctttcagccgctaacccttgatcctggtggcatctggagagttccccaattaggcatcatcctgcgccttacgacggaatttttcaaaacttgatttcatgcaagtgattgatgagccttttccaaacttcaaatagtatcgcgacgctgaagtgacatccatgtttgttcctcactgaccattccttcggcaccttgctgccttgtgctcagttatcatcgcctttctcatgtcagctaatgggttgttttgaggagttgcactgctcaccagagtctggtctcaccgagggacatgatcctgcgggtattcttgataggtgtttcgagagctgggcacagtcctaccaatgccgccttcagacactgcaggtgcagttgtttcttcggcgacctgtgaaggggggactgcgggcgccgcaataccgtgcgctgccattccaggacctgcagtctctggaactgtagtaccaggagcttcggcgtgagggacggattcatcataggctgcagttccttggttcccctcgagcatcgtggtagctgcttggcgttgggtcgcgcggtctttgcgattccactcatggcgcgcgaccatggcatcggctccctcaacgtccattttgcccttctcggcggcggctctgtgcttttcattcctggccacgacggatggatgttgttggtttggctcgaaggtttggtcggccgcctccattagagatccgcggactgtgtcgccggctcctttgatccccttgaggccagatttgacatcgtcaataatcttggacatggtttcggtttgatatagatgcttgaacttgagattctcaaaagttgagtgtgtgcgtaaatgaggcgttaatcaagaaatatgggggatatatgacagcttctggggtttctgttcctatgacgtatgagaaggcaaatgagaacaaattgatgtcatggactcacacatgcctttcatttacccatgtgacctttgatggaccactaacaagttggcaaaacaattcagaacaaataccacgtcggtgtacttctacatggtaagtagcaattttcatatccaattgtttgatgctggtcttgtgcgcatttggagttgccctaaaaagattgagtagagagacactcttcgctgtgaatcagcttgtaggagcgctgaaattagttaacttccggcgcctattattccaagcaacgttgtccacggcgcgcccacattaaagaaattgccgagatgttgctcacgtgagccttttaccaggcagatccaatgaggcaacctcgattttgcgacgcgggggcttatagcatcaaagttgaggctgtcgggtcaggcatttgcttgtaacaaccgaataatccactcaagtatgtatggtaccttcatacaaaaggtgctggatgtggtccaaacgtttcaagtcgagaatggcttcagtaagacaactgctcgtggccccttaatccgtagccaggcaatttccaacgttcatcatcatcacggcaaagagcttggcttctgcatggaggcgaaccatgattacacctagggtcaaaccattcggcatcactctcctttcggatatggagaccagcatgagaatcaactacgagcattaaaatgattcgctgtctgtaagtactgaaacctatcttaaccgtaacactttaatcagactttgtgtgttataagaagagtagacttgtgaatggcgttgagtcatgcaaaagtctcaatatcatacagcatattcaacaccggggaagtagagagactcaccttggcatgtgaacatataatccaggctccagttctgtttgacattttcgtgccagaactccaagttcataaatgaaacctattgatgtgtattgtacgatgtgaaccaacataatagttatgcgttaggggtagtgggccgtatgcaaaatctcaatatcagagccaaagaacaaatcttgttgatccaaataggttgaccgttacctgacgtgtttctgggtttgctaggcagttctcaagatgcatccggcacgtcatacggatctccccttcttcaatgacacagtggcatgacaaacagtcactgtttcaatagcctcgctaacttaggaaaagaggaggctttccttccatgtagcattagtagagaagtatttgagtgattcttctttgctaggagttagtcttatccgcattagagataaggttcgtagaaacacgagtcatgtggcgctttcaccccacaacggaggtcgaagcccgtcacatccctggtcatctccagggaccgcccgggccacacttacataactgtcccaaagatccaaggcacggcattggtgacatacctagattactgcacctggcgggttagaagaaaaaaaaggacatgaatgtcactacaggcatgcgaagcaagtgggtctgggactattcacttgggggacaatcatagaatcaagttatggaaggacgactctctcagatatttcccaacgattcggtcaggaggcttccagttaagcatttaagcgttggggaagagtccattaaggatagcaaacagttaatctccattcagtgtccaggggactctaaatttatgccatcctcataaaataccagacctatcggagaaggagccagctatcatcgtgtaccttatctaaagaggcctcccctcactcatcgccctcgaaggctgctgcgttcagctccatttcttaggaagccgagagagatatacgtcggccaacttatcaaacgcaaactcttcttccggtaaatactcttgaataagaccctcattcacggacttcaataaaagagcttcttcgatctcaatttgtctcccgtgggctgagaaaataagctgtcctttcctcgactcatccgccatcaatatcgccgctgatcgagcaggaacatctgttccttgtagtttggcttcaattgcttcggtgatccgctgtgtggcaatcccggtctctgtccaattgggagcaatgccattaatgcgaatcgcagggtttaagactttgagattcaaatgtaggccacggatgagtcccaaaacgccatgctttgccacccctattcattcgcgtatcaagtcagcgtcgattgttccagtgggaggaggaatcgtactaaccatagtctgtgcatccaaacctttggaagcttgacgctgaagcagtaataacgatgctccccttcttttgcttcatgaggaaatgcaaacccatagtaacagtgtagattgtccctttgagattcacgtcaacaacgctcaaatttggcgggactggtttgccgttctcgtcgacttcatcctccacgaagagagcctttggcgcgaccccagcgttcgcaaatacatggtctactttcccgtgcttgctctcagccaactcaaacaatcccagaagatcatcccatattgtgatattggtttgacggaaggcgatattctcgtgctcgatgggaacggggttcaaatcccctgcaacgacgaaggccccaatatccaagagcaatttggccgtctgtaggccaattccagatgatgatcctagtgttttagtttagaagatacatttctctaagatagtacgggcgaagtagaaataataccagtcactaccactgtctgccctcgaaggttcgcaaagtcgccgtcattgatggtaaactcggacatcgcggcgagatctgatcggaaggtaattgttttcaatatagcacaaacctggaagaaaaagaagagagatctcaggagatgagcgttcgagggggtttgtaattctctcgggattgtataccctgtcccatgtgaaatgacgtgcaaaagtagatgacttgcatgcagcagagtgcggggttagatggacacatccaatcaaatcagatcggatacgatctcgacgtattgagaaaggaatcccaatataaatggaaatattggatgccgaggctgctgagggttagggaggggctgctgggataaatcatacgtactcacatctgggaagggaaggttccagtggaagcaggtgactcgggctcaacgctacggtccgaccattggattccccaagctctttcgagtcgcgaacaggcttggttttgaagaccacgcaggaagttaccgcacttatgtagaaagattagcaaggggaaatgccaagggcatttaaagccggaaacaattcaacgcaatcaattcttatttactattaatgaagtgttaatgaatcatcatctttcttttagatgctataatcaaattctctccgatagatatcaacatgtggcgcaggggaaaaacgacaagccctctcttgaaaattttcagaataccctcgaactgaatcactctcgagctagaattgaaaacattggaaggaggatcattatgaagatcaaaaataggaaaattcgagattcgaaaacttaaacccgtcccccggagtaagtttgcctcaattccccttcgcccaacttggaagacttgtgaggggacctatctcggcaatagcttcgtcccagacacccttctgtatccgtagcccctccttcgacttgaggaaggcaacaggcctaagttctatggttagcaattatagagagaattttatctgcgcgacgtaggaactacttactcaactatcgctttatctccgagaagcttcccgtgtgtctccttgcccgtaacgacggcggcatggagggcaacccagcctgatacttccaccgggcggccccggatggcgagctgggccttcatgaggacgcggagggggaatggaagaacatcgctcatgttggtgcgtatcgatccggggcagaagttgttgacaatcaccatgtcgggtgatgaacgctttgcaagctcgtcgagaaacatgacgactgcaagcttgctgtacgcatatcgatcgtacggccccagactattcttgtcgacgtacttggataatgaatctgtcgacttcagctgtacttttccggttacaagcgacgaatttaaaaaggttcggctccccgtccacgtaatccgggatgcctttcctgatttactggcagaagattctagtaaagggaagaggccgaaagtgagcaacacgttggagaagaaattgacctggaagttgctctcgtggcctgtactcgccacctctttgtggagggtgccgatgcccgcgttgagcatgagtatgtttacctcagtatagtcggcacggatctggtcgatgaacttctgcacttccgggtaatcgcccgtatccaaccggacgacatcaatctttgctttggggtgagccgcaaggagctgggtcttgactgtctcgcccccagcggtatttcgtacagcaagaatcaacgtagataaaccagcatccaataactgtttggatatctcaaggccgattcctcgactagcaccggtcacgattgcagtttggccggagagatcaagcccagcaggaaggggctcgaccggtggctggaagattggcatcgtagggcaatgttgccgagggtatggacagtaaggataataccagcgagggttgagaggtttgaatttatgtcgtctcgcgaaatcattgaagtgacttattgcaaagcgaacagtccatttgataactgcaatccaagctgaatatataccagtgactcgtcacctgtctggtcccgcactgtatcctctccgctcgcaccaatcttcggcaccaaaaccgaccagtctagagatgaacattacatgcggaatctctcattaattcgcaattatcttctgccaaagtcaaaacatgggactggaactccgcaatcctagcggaggtttggattaataatgtacactgcctacgttcctaggtcagttcttgatgtcggagacttgaaaagtggccgaattgcaccgaatgccgaccatgagcgttgtggggagacgagccacgaataaaaagcaccaacgccaggcgcaagtgggaaagtctaatgagccaaatttcttaaacaaagagactacgcggagattcagctacaaaaagagggcgggcggtaaacatggtattgttactactgtcaaactaaacgcatcctcaagcgaatacgccggaaatccatgaatgggcctatcccatgtcgcctttttggtcgagctcgccgccatttctattcaagttattggcttgtctcaattagacggaaggcatgactctggtggtagtggtagaaaccattcgctatatccatttcgttattctctccataccaccaaaatggtactgtccaaattcatccagcaattaacaaaaatttggtgttgattcttcattattcatgagcctttgaggaattatgctattaatccctaatccaagagcctaaagacgcgagcaaatcaagagtatttgcaccaagaagatatattagtccagatcactgtggtatgtgtggtcatgcccgtgtagaagaaagaatattaaaagctagggctcacggccaaatttctagtcccttgactccaccaaggggagccttgctatgtatgtcatctttgacagatgacaacacattgtatgtcgagaatttctagtgttattgggttgagctggtcaagcgcttttgtgcgggatgagtcagctatcaactacaatactcccatttatgctctgtcttatttccaaagagcattgcttctgacgatcacccaactgatttcattctcagggccgaaactgaagttgtcgtgggtgatattcgatttctcgggagacggtgcaagtggactcatcctcacttacgcaagctctgtcgtcatcaaattgattactatttgcctttgcaattggaaatcacatacaaacgaagagaggttatgagcgagggtctctgcacgaggatgccataatactcctatgtctgaacactgagccgagaaatagcgacccaaactgaaggtactcaagtaatattgtatactttcgacagatacactgtcacatacgaccatacccattcgaaaacacgtggtcccgtgtacctcttgtccgacaagccttgcctcctttttcggacaccgagtcatcaagttttggcccaaacccgagtggtgatgtttccaatcctttaacgcatgttactcgcggctgacttcgatttaatgagacttgtcctgagccaattccgcgaaactttcccaattctgcgaaattatacggtagtatgtttggatatattagataagttattatcgaaataaattacgatgtgttggtgtgtttatttgctgctaggtcgcaattgcagatctacatgtctagggtaggcgccagatacagtgaagcaagagacggcctttttgggtggggattgtaactgatgaatgttaacattcatgcatcacagctcacagggacggtcgattggccacaccgctatcttgtggctctggcacatcccatttttgataaggagtaatttaccagaagcaacaccaagtcgcttctgcaaggcacatactgaatcctccgcgcttctcgcatatttgatggatccggtagactacattgccatacacccattttcatgcccttgctaccagccccggggatgaaaataccagagatggaatagtctgctctgattggccttctttggccgagtcaccggcggcgcggataccgtcacaaatgacacagagaagcattcatcctgcctggatttatcatgttttggtcaaaatgccacggttctaaaaatggactttggccaatcctgctggaagaaacgaggaggcttatgaaactcggacccgagaaggtgcatatcaggcccctccttagtcacgatgatctagaaattctcggcatgagcgaattgatgcggtatgtgggtgaagtctaagaatagggagggctgagaattagtctcgcatatcaacacgagcgacagaatacggttagattactctcgtaatctgcctcaaaaagatgagcacgcgacgcttacaggggacttcggtaaacatcagatcggcacatgcgcccaatggagactagggcatctgcatctctttggagttttggaagctctaacaagtaaccgacagggtattcatccgcctgatagagtccggccaagaggtactttctgtgcagcctacatattcaatatttgatgttgaagtattgttgatcagtactctcaatatcagggtggacttcgtgactagccacgattgcacctagaattcgatcttctagggccttctttggtgtcttcacagcaaatcaagtggggaaagacctcgctgtagcctccgataattcaaggagattgtcagatgtgtaagcccactgtcatgatcctgcgaagagccccattaaacggagggcagctagctaccaatcaacgctcagtgggccacagctttatgccatagcaagtttagtgaatgacgggagagcagcctttgattgggttagtcttgccttgtaagatattacaaggtagaccgttgtatggataaggctgacccgccggtcaaagcttgaccacccacaagccgtacgggctctcgctcccgaagatgctcagaagccctgcaggaactgtctaaaaatggagggctgaaaaagtacctgcatcacgctgcagaaatatatcaatggttctcccagatcgtcagtgtctggctgattcactctgcatcttgtgcttttgaatttagcaactattccttttgtatttcctttccgttttcctcctcccccttatcgagctttctttctcgaattttcttctcttctattgtttttgaaccagttactgccggtcaggatccggtgttgatactccttcgatttcatttcttcttcttatgctaccgttatgatgatgcatattccgagagctcttttgctctctctatcgttcattctctttttctttctagggagctccattgcgacaacagtacaacatgacgcagcaagccccgatcatcccaaggataagccggccctgctatccgccgacaaccttcatcaccggagcaccgacgagaccaatattgcactgctggatgttcgacagcctggtctgcttggcaagattggcaaggtggcttctgccgtgaagaaggtcgccgccccagcgaaaaaggttgccactgctgcgaagaaggccgttgccccagcgaaaaaggttgcctctgctgcgaagaaggccgctgccccagcaaaaaaggttgctactgccgcgaagaaggccgctgctccggcaaagaaggctgccgcagctgtgaagaaagctgcttcaccaaagaaggctgccgcagctgtgaagaaagctgctacctccaagaaggctgccacaccaaagaaggccgctacctccaagaaggctgccacaccaaagaaggccgctacctccaagaaggctgctacaccaaagaaagctgctggctccaagaaggctgccgcaccgaagaaggctgctacctccaagaaagctgctacaccaaagaaagctgctggctccaagaaagctgccgcaccaaagaaggctactgctaaggccggtgccaagaagactccggctaaggctggcaagactgctgccaagggcaagactgctgccaagggcaagactgctgccaagggcaagactgctgccaagggcaagactgctgccaagggcaagactgctgccaagggcaaggccccttctaaggctggaaagaaggctgctgcaccaaagaaagctgctgctaaggccggtgccaagaagactccagctaaggctggcaagactgctgccaagggcaagactgctgccaaggccggtgctaagaagaccggtgccaaaaagactcctgccaaggctggaaagaaggctgctgcaccaaagaaagctgctggctccaagaaggctgctgctaagaagactcccgctaaggctggaaagaaggctgctgcaccaaagaaggctgctggctccaagaaggctgctggcaagaatgctgctgccaagggcaagactgctgccaaaggaaagaccccttctaaggccggtgctaagaaggccggtgccaaaaagaccccagctaaggctggaaagaaggctaccggcaagaaggctggtgctaaggctggcgctaagaagacaccagccaaggccgggaagaaagctgctgctaagggcaagactgctgccaaaggaaagaccccttctaaagctggtgctaagaaggctggtgctaagaaaaccccagctaaggctggaaagaaggctaccggcaagaagtccctagctaacgctggaaagaagactgctggcaagaaaactccttctaaggctggtactaagaaagccggtgctaagaagactgccgccaaaggaaagactccttcaaaggctggcaagaaggccactggcaagaagactgcttctaaggctaccggaaagaaagctgctggcaagaaaacctcagctaaggctgccggcaagaaggcggctggaaagaagactcctgcaaaggctggaaagaaggctgctggcaagaagactgcttctaaggctgccggaaagaaagctgctggcaagaagaccgcccccaaggctgccggaaagaagactgcttctaaggctgctggcaagaagactcctgctaaggctggaaagaaggctgccggcaacaaggctgctggcaagaagactcctgctaaggctggaaagaaggctgctggtaagaagactcctgctaaggctggaaagaaggctactggtaagaaggccccagctaaggccagcaagaaagctgccaagggcaaaactgctgccaagggcaagaccccttctaaggctgctggaaagaaggccgtcggcaagaagtctgctgctaaggctggtgccaagaagaccccggctaaggctggaaagaaggctgctggcaagaaagctgtcggcaagaagtctgctgctaaggctggtgcgaagggcaagtccggagccaagaaaacttctagcaagaagactcccgccgccaaggctggtgctaagaagcttcctggtaacaaagcgaccccgaagtccagtgccaagaagcctgttgacagcaagactcccgccaaggccaaggctgcttccaaagaaaaggccaacggaaaggataaatctgccactccaaaggctgctgcgaagtccgctccggtgagctgccctttgaggcgaaagggaaagcgagatggatcagacaccgaatgcggcggcggcggttcggaaacagcagcagcatcgaatgagccccacagagatccggagaataagctgggaatgaagccgcatgagttcgatgtcggccccaatgacaagaaaccgaaggcctacggaacagttctcaaagtgaatgagggtaaagaagtcacagacgagcagcttgtcagcatggccaagaacgcccatgtttgggctgacaagcagcctggaaagacgcccacagtgacgactgccggcactgatggaaaggaaatcattattgagacctctcagaaggatggcaccgcccgattcaaagaagagaagactggcgaggatggctcgaaagagccaaagcatcctgacacccaacagcatatgagtaaatccgaggagcaatggaaggaggaaggtcgaccaaagcctgtacatggaaacggaggaaaatgcggcgaaatcaatactatgtgcacttacgagcaacgaaaccccggcaagaacattcaagatgcgaattacagaatggtctctgtccataccgaaacgaagcctccgaagggcgaagccctcaaggaagagcatgtcggcgtttgggcaccttgcgatggtgtaagttgaaccccttatctttactattgagacactgacgaagctaaccactcttgccaacacacagaggggagatcctaaagatcagggaggttgcaacaccgtaacccagaaagccaatatcaatgtcgttccagacaacaccccagctgctccatacaatcacgatgattacacagttgcggaataacatccagagtctgaaggaactagagtatctgattgcatttgagaatagcaagcgccggcgccgggagattgaaatttgggcctatgattttcttcaacttctaatgctctctgagaatacgcaagtattcctcatgaggcatgcctgtatttatttaactagatttattattttgcgatagatgcggtatatatgtttttctctagatttttccaaggccagttgattcaagctttcatttggcgactagggctaaatgccgagttcgaccgcaaggattgagattgagacgagtcgcgtggtccgctatagatgcatggtatgactcttcccagtgcctctagttcgtccgtcactttcccaagactctacgataaatcacttgcaaatcatgtgtagaacggggagggattggctacaatgaagtgctagaattctagcattttgtggcaatagaggtgccattcggtaccgtactggatgtattgcccgaggatggcatacatctgcctctcagggcccaggtggtcgtgttgtcaagactataaaagcagaaggtaggcaccattggtaagccgtctgtaaagcgaggaggattttcagctgcaacgcccaagctctatttttaggggtgggcgttaggcacatctgccacccacgtaagcgctacggcactgcttgagcggattacgggagatttctactaccaagcatatcatatatcacaacacacttccgagatttatccctccctcatgcaaccctacctaatcaacaattgatatagatatttgccgcagcactgggaacaaacacgctggtctgacttttccacctcccatctccctatcctccagctgctcgacgcagcgcatgtgctcgcttcgccatggcttcattttcggacgcccccaacgaggtcattgaccagatcctgagcgatgtcccgacgtcggacctgcccagcgtctgccttgtgaacaaagcactgaggcgctctgctgagccatttctttactccgccgtctccttccagtgggattttcaatcagtaccccgcgttgctcctcttctcctcaccctcttgcggagacctgagctactcgactatcttgataccgtgacgttgcaaggccgtctgttcaatgagagatcccctccgcccccaataaacacagcgaacatccctttcgatgaatttattgctgctattgaaaagaccggtgtggcattcgccagcatgtgggttgacaagttgaggtcgcccagcacatgcatgtacgcaatggttgccctcttgatcacacaactttccaacactactcatctcactatcggccacccttatataaacggccaatcgctcgtgcccaaagtgctcaaggctaaaatattcggccaactacctgcgtttgaacaactaagagaactccgatatctgaagcgatgcgatatttcatctttcgaaaacaatcagatattctcggataccataaatctcttctacctgccaacagtcacacatatcgaggtctcaatgacaaatccccaggatttcaaatggccagcaggcgagccgaacttggaccatctcacctcactcaagatcggatggcttgctgaaccattcttagccaagatcttttcacgtacccgaaatttgagatcacttcactggacttgggaacaccatggtgattgggttggtccttgggaaacgactatccttgactttgaaaatatcatggacgccttacggcctcttaaagcctcactagagaagcttacattggagatgtacctcgggctcgatgatgagttggctgataatctcaagatgaccgtcgagggaaatctgcgcggtctacgcggcttcccccggatcacacacctagacgtcccattaacatcgcgcagagcggacaactccgatcctttgccgctagctgactatgctcccgatagcgtcgaggttctcactctttctggaagtgctttggttgatgatgaatgtccgcatgagtgggatgggtgggtggaacgggctgaatttgaggatctagttcctttgattgaggatctagctgatgatcgtccttcaaaactgccacggctgcaacgagttgagattatcgatgatcatggtgggaatattcgacgtcaaataggagggcagatcgaagcgcttgatctcggtttcaaagttcagatcatttagctcgggctggcaccttcttattataactatttttatttttatttggttaggtagaacaattcaacgacttctttcgacggctcatcgcttggtatatctgatatctgaccattatgcttattctgtctactggttgacgattgtagatagccaccttgggagaaaacccatggatcatccttcgaatgcttgagtatgaagcaaatgcatcgaagccacctttgagcattaacgccttatattcaatcccacaggctctagcatgaagaattgtcacttgaggcgagagacgatgtgacactgatgaccggcgatgtggggtagcattccattgcttcaaatggccaagacaatcaaccacatgtttttgtcagaatgtctcaatcgagataggaaggtaaaacaggatgcctatacttataggcccccgattcctccaacaaattacaatttcccaatcagcttatcattcttgcaacgcgactttctatgcccgcattagacatcaaatcaacggaagaccgccatgaagtttgctctatttcttatcaccacaggcgcagctctggcagcgccatcagagatattcatgaaggagggtaatatattttgctgggacttgtgtagctttgaagagcccaaatgccccgaccaaatggtacgtccacataacccatgatctgggcaaatatctaacagcatgcgacacagttttcgagcttcaaggatccatgctggacatgttgcggggatatctatctaagtcaccaataaatagcctggtttcgcgtcgagtcgccgctctttgtgcgggcggaatctgttccaagattgaaaagttcgggcaatggggcacaatgagatgagagtcggctcaatgagtcttgagttcatgagtctacggatttctagccagatgagaaaaagtaagaatattctaagtcccgccgctcgttgcttcttcctcatcagccactttgcgttgtgacttctttctccatagcctgtagaacaaaaaacatcctgccgtggctgggactgtgaagagaatccaaacccaaaagcggtcggcctccttgagccaggggttgtcactgaaaaacggcattgataatatggtctaatgatacatgcgtcagctaggcaactcggggaaatgtgatttgcaatgatggtttctcgagagtgggaggtcaactgatcatgtaaggatgccgtgaaacgggatgaacgtacagcaaaggtagctgcaggaaggaatgccatcgtgataatagcgatctggtttaatattagccctcttccaaacatagccagcttgtcgcgcataccgttctcattgcaatgctatccctcttcatctccacggcaagttggtgtgatgcatctgccattttccgaccaacatctgtatcggcccgcatcgctctcaagatctcttccatggccctgccgttggcaacaagcagtctgtcgctgttgatctggatgcggttaaagagctaaagacaaccaacgtcagtctggggacaattaaaggcccaagctacggtccagaggatttcagataaggcacttacgagatccaggatattctgagtcttcttctccagctctgtcgcaaagtcaagcgatgcttcgatctgtgaaagaacctggttgaagccccgtttcgccttctccagcccttcatcctcgtcctctccctcactgtcagaatacatagaagcataaaagtcaatcaaatctgtcacgattccctggagagacttgagctccgacaagtagcgatgcagatgcgcagagatagaatgaagcgcccggctcaattttgtaagcgtggcttctggagtcacaccggctgcatcaagctccgactgaagcttcatctcgtaggcgatgagctgctcattcacactgttgagcgagttggtccaccaccgcacggcgctgctgatgtagacgaggtggacgaacgcgccgttgcagtgcctcgtgctggtctcgtccgtgctcttctggtgcttcatcacctccgcgatgcgggtttgaggctcctgagcgaccttgcaccatcgcccgtgcatgaaatcgaacgtcacaaccgtcaccttcttggaggctgggtctactctggtgaagacgcctatgcaggagcgaaatatgtttcgtcgagcattgggcaggtgaagcttgtggaatgggttcatctgtcctgctcctctctcgtcttctgcaactcccgcttggggttccatctgtacgcggacggggatgaaataccagcagtcgaacacctgggaggcatcattgtcaattttgagctgccgaaatcctctgccgttggggagataatggcgagaaagcgcaaagatgaaggccgagggaagggtaagtcgtgtggccagcgcttcgaagcttagcgctgagatttgcagtttttcttgctcggctggcataagagggttcgcaactaaatctttgtatacgaagctttgggcaattggtaagatttctgaaatgtaaagggtagggctgatatttcgtcttacaagaattcgatgctgttgttggctgatacgtcgggctgcaaatgcggtcagtgagaagatcaagttcgataaaataaatagccctgggatcgaatcaatccaagccctcggagatgaaaggattaccaatctagtgatgtccgtgcgagatctcagcgtcagttcctggggttctccctcagattggtagtgaacataattgatgtttgtagtagccgataattgtgactgctggaagctctcaaacgactgtgaaattgacttggcgtgctcgctggattgtgacggatgtgttagtaccaggtgtaattttataacacagataccggcaacatgataatgatttcctacttacagctctggtgcttgagcggccttatatgccttggtcttgctctgcctcgatgccatattcacggcacactgtaacgacttcgtgaaagaaaagaaaaggttggagcaatgggcttggtggttgagagcccctcgtcatattgctgcgtcaagaccggccagttcagctgaacggctctagcgctaggtactggaaagcctacttccagggtccagccgtcattctggtgagcaaagtaacatttcgccaattgctgtttgtacagcctctgcaggggtctgacatgggtgtcggatctcgaactacttcagtggcaactgtcgctgtgttatcactaatgtgagcttgctgcccaagcgaattactcattatctctcgaataaacccacaaacacggcctcttgcctcgatacgttgaaagtttcttatgctctccaaatggcgggtggcaggcgaaaacagcggtacaccgcatccaacctggatccgtcttggaatgtccaggacgaaatgccaggagagagaagccagttctttattccagcagaagcagcaacggaagggcctgaccaagcaatcgatgctcaatcccccactatctctcgccaggccactccgcactcggatgccttctcgccgcctcgcgctacaccagcccaagatcagcaaccaatcactcaacaattgcaatcccagtcgcaatctccctctcacctggaggtcctcgagctcccagtaacacagggcagcacaccgtccagacattcgcgcgatggcgaggaatcggtctcgaccgtcagctcctcagcgccatcacgttcagccaagggcaaaaagaagcgatatgtgacagagcattcagccgactgggtcgaggaggaccttgtctatccagctggtcccagtctcgggccctacccacagcagaccctggccgcgatgccgcatcagccgcagcagatgccaccatcatcgtcaatagttgcacagcccccagatctaacgacgccatcctccatggccacgacgtcccctgccctctccatcttccgcggcggcggccaccagaccaacagcccgggacaggatgcgcctgcgatacagcctggggcgccgtctgcgtcatcgccagcgtcgccgttcgcggacgtgggacagccaagtgctcatcaagctcagcaggcgccggataaccatctcggtgtcattatcgaggagcagcagcagcagactggtcctccagaaccgccgccgccgccacaaccacacccgcaggctctaccggcccaggcaaagcgaaagggatggtctaggctcctgcggaggggctgacgcgggtgatctgtcactagccattcgtctctcgggtttagtgcaggacgcctcgcctccatattcaccaatgtgtgtagtggcaagatgcgacccgtgtctgcacagatgtgagatgcagtctggttcgcatttgaggcagactggcggcattcagctgtaggtaacatcggtagctatgacgacactggaacagctcacagtcataaatcttaataaaattcttttcggtgcccaagattgctgtcttctctctccgtgtctccaaagccttgtttcattgaccaggtgcatcacatcacatcgcaatgaccaagtccgagcccacgacaccgaatcagccgattcctcccaaggaatcttggagcaatggcctcctccacggcctcaggaagagtaagttcacagatggactccggcctcataaggggctgtcggctaacttgcagtgcagaggtgctccatcgcagctccaagagccaatcgtcgttttcatcatctggtgatcaaaccccaactgcgtccggcagcaacaatacttcgcaattccttgcctcgccggtacaagcgacacccccaatcagccctcatcagttccaatacccatacccgtactcgcctgttcctcccggccctccaagtctgaggcaggccgagatcgaccgcttcgaaggctatcaacagcaactacctcctccgactcaagcaaaccccaatgggccgctttccatgtgctttgccgttgacgtctcaggcagcacccgaggtcgggtcctgcgagaggaacaggcagccatcgatgagctgggaagtgctctgaccaagggcggccagttctccaaggatgaggcatggatcttgccttgggatgacagagcccactcccggcgcccgttgaatggtgccatgagtctcgtctcgggagctgggacacgcccgtcggccgtcatcaacgatgctattcacaaatacactctccaaaactcgggcctctggtgtcttatgacagacggttacatcgacaagctcgaggtgcagagctttgccaacgcgatcccaagagccggcatccacggcaccgcatgcatcatcatcacattcggctggtaccagcggtcgccctttgagtgcaatgtgtcggtcggcatgtccgtctttgccgtcgctccgcactgcctgtttctctatcacgggatccaggacagcaaagtgtacgtcttccaggccaagggctgcttcgagaagctgctgccggaggacaagcgcttcgtcgcattcaatgcatccacgcaatggcgagacctgcactctgtctcgtacgatgaagtggcccaggtgcaggtgcctcggcctatcaagctgtccgtagactctgttctgctcccctcgggtaagacgtttgacatgcgatccatctacaacaacagtgtctctcaacaagaccagatggatctgctcgccgattattcatcccttgatgttgttctccttgccgccaagacgagaggaaagagcgctgcagtgaaaaattgggcggagaaggctcgtaaggataatgaatccaggcagccgaagtcaatcaattgtgaagacttgaacgggaagggcacctctcaactcaagaagctcatcacccacatcacgagttcagacgacccggatgccttctgggatatgcttcgaagcgaggcgtcttccgacaagccacagatcgaatcgctcaagaaagacctgaggtggcagcacaagatcaactgggacacatttgagaacaaggtccgcgaggaggccgagctgcccgggaaggtgaacatggctttcgacgaggtattaactgccatctcgacctacgagacgaaagccaaccaggacacacccgccgcgctcaccccattgtcttcgcccatgccagcatcgccaccatttgaccctaatgatgaatccgatgacgatgatgctggaactccgcgtctctattccaatcaatacgtccctccccccgctccaacgagccccaacatgccacggatgagccccctttcaccatcggcgggctccgtgttccaacaatacaacggcttcgttcatccatctgcaatgttcaaccccggtaccgggccacctgctataggcccctctcacgtcctgcgatcgcctcccatgagtcccggcaacatccctacctccagctacgccatgacattcttgtcagatttcacagatccttcgcctcccagatatccttcgcagagttacagccagaactacaaaacctgcttactctgcggcaaagaatcatccctccaaaccttactccttcagtcaaaccccacgacagaggctacccgcaatctacccgcgccaaacacccggtctggtcatcgctatcctctggtactgggcagctacgccgagaccgacatcgtcctccccatggtatgctgcgacgggtgcgcctttctcttcctccgcgccggcgaactccccaacggaggaggccgggtcgccgccgccctgcctctggtcccgctgcacgtgtcttccaaccggaagaagtgggttgaaaccctcagcgccgtatacgatcaccgcttcagtgataggatcgtcctcctcgtgtttttgtccaccctctgctccaccatcgaggacattgccgagagtggcgacgcgggtgtccagcgtgtccgagagagtctcgaatggtgctgcagggccatctcgcgcctctctggtgtctctacactggccggcctcacgcccgtgggcagtcccctgactggcatgattgatgagaggatgcccatgcaggacacgatccgcctggcgttctccaacgtggggatcaagccgacggcaacggagtcaccgctgctgggctacccgatccatggattcgtcaccctcgtcaggctagcctctctattcgacaccatcgagccttcagaaattgagctgtttgtttggaagaggctctgccattaccttgtggaacagcattcccacacgcaagccaggatcggggtctccgaggcgaacgagaagctgaatgccttcctattcgacggctctgctcaggacaaggttacactatccgacggcaggacggcgcgatcagtctgccacatgagtgatcttatgggcacgcatctactgaaccaggacgcagtcgatcaattccatcggatggaggactactttggcgtgatgcagagcgcgagcaactacaaaaacgcgctggccgtctttctacacattttcaacgagggtctcaagaaccagacgcgggttactaacgccgccgaattctttatccagttgagatatcgggcggataagcttgtgctgcgaaatgggtcgctgaataatgtcgtggaggagccaaaggcgaccgatggggctatggctgctgggtcgattgatctaatttacaagctagatgatttagactgattaaagttttgatgaatgagattgtattttgtcaggtttggtcgagggggctcatggggattgtcactggggataataagaataatctggagggaagtgactgcatggggtactacgtttttttattatactgccaacacatataagaaacactaatttaattcctagacattacgcatttgagcctcaattaattagtttaaacttctcttcctctagaaccactaaagaaaagaaaagaaaagaaagaaaagtaaaaaggtattccatgtattatccacgtcacggccaacccgggccaccatttctcgccaactcctccccagtccagtcccacagcctcttcgcaagcccatcatcgttcgtctgcttgctctcccgcccagccgcgcctatcggctcgtagtaacggccattgataacgcctttgctaaaactcgcccacagacccgtctttgctccctcatccggcgtgacaccggtcagagccagagccggtttgaggatcaagtaccggatggcccaaggcagatccttgtcgccgctgtaggctcccgtcttgacgccgccgggatggacggacgatgaagtgatctgcgggtagcgcttcgccagctcatacacgaagagagatttggcgagcatggactgggcatagagggctcgtccggtgaacgatttcatatccgacttgagttggtcgaactctatcccttccttaagtccaaagatcttgtgagatgctgacgtggtgctgacaatccgcacatcggctccgggaagcttggccgtctcaagcatcagaggcaggagtagctgcgtgagcagcgcgtgtccgacgtgattggttccgagctggatctcatagccctcttttgtagtcgcgtgcggcaccatggcgacaccgccattgagatggagaatgtccagtcggtctgcctcggaagtcacgcgagccgctgccgccttgacggactcgagggaggccaggtcgaggtccagaatctcgacgttggccgtggaggcggtcttggaacttgatctgatcctctcaagggcttcttcagccttgactcgagagcgggcagcgaggtagatcttcttgggcttgtgctgggcaagcgctttcacggccgcttcgccgaggccagagtttgctccagtcaccaaacatgtcttttcaccaagatctggtatgtcgatgctggggttgaattgaggcattttgggggctctaggggtttgataaagctaagtttcgcctaagattcaaagtatctgtttagctgattatgtggtgagtgagtatcgcaggaagactgttgatgcattcagggtgtctactatttataccaaaatgtctctgttccatcagcttatcaggccattataccaatccgttaactccttcattccgcggatttatatttgttattggcaatttcacctagaccggtgcgtagactctagtcagggtcaaatttagcccagtgccaagccttttgtgtttacccgatttggcaatcgttggagatctccggagtttatctcggccagggccgtaagcataaaagtgatgtcacctaccttacaatccagtcggttgaaagcttaaatttaacacctggacaggttgtaagggtagatgctcgatgttgtatgtccatgccttttattggtgactggctaaaccaaacatctggttcactacctaactctaccgcaactaccacttgagattctctgctgatgcaagtgattgcttgtgccagttccttgcctccgatgtagtgttcgtttggatccttgatatcctctactgacgttgttctccatttccaaagctgggtgtactcgttgctcttaccctcaagaacgtcaacaacgtattcaccaagaaccgggagaaatttgaaacctgtcgaaatgtcagaacacctttcaagataagcaagagaaaaaaaaacttaatagcccataccgtgcccgctgccgcctgtgacaacaattaaggccctccgttgaaggaactctgtccatgacaaactgaagatcaactgtatcggtgtaccagcacattttagcttgggtgatttcttccccaaccagttccggcaaattctcttcgatgaaggcctttgtttcctccaaggggggcagaggcggtctgccttgactctcgatctcctcgatagtcgcagggatcgaaatcggagcctcttgcaaagtcgatggtacggggcttgtccatttaggcgatcgatatgaaattttcaagtttccgtgtcctaagagattagttagatttagggaatgtcacgactagattaacaagcgtggggacaacaggtcattcttactgtccactggaaagcctgtcagaccaccactttcagagttccccgagtagttccatgccaggtggggaagacatcggcctcgtatttatgccggagatgctcagggaccttaacgaaaattaaattgccagcagttgcggtcacaaatgactgcagttccgggacaatctgtggtgtgtacgggccagctgctacaatcacataatcagctctgtgctctttcccgtccttggtcttgattccaatgacacggttgggctcattctcggcacggatgaaccctatgaattctccttgacttggaccgaagatcgttgtggcgcgtccggacttggccaactgaagagcatacttgcatgcaagatctgcttggaccatgcctgcatttgcgtcaagtacaccatccagtggcaggcctcgctcccgcctgttgaactggtcgaacctgggcccgtaccatccttgctcccgggctctcttcaagtcctcatcgttgttgaggaaatactgagtatccccaagcctggcaagcttgagagtattgaaagtatcaatatcgacatcccggggtctcccaatgtcagtcacccgggcccagccagaatgagagaacaactcgacgccagagtcgacattccactgcttccaagttcaaatgcctcggttcgcaaggtcttgtaggggcttgttcgatccataggcgctacggatcaccttgtgactatctaatagtcatgaattatttgcaaaatcgataacgagggctaacaaataatatatgtactcacctgcagaggctaaatcgccaccatcgaatggagagtaggcaaatttgtggtaatcttgcttatcaaagatgataacgttcttgaaccctcggtgctacagatagatagccgttaaaaggccaaagactcccatacctaagcaataccgccttggtttgccagttggattgattcatctgttacactttcacccaccgatgatgatgaaagaactactaggactggccatatctgcgatcacagactgagtgcttgatgaaaatataccccgtaatatccccggatgctcctaaaccgtgccaactggagctatatgtggtgttatacctgcttagccaaccatcagtggatcaagaaatacccatggcctcgaataagactttctcctccatgctatagacactttgaataatcgctcggattgtccaagatggcacatatgacatgattctgttcgccgtctccatatccaagtaatgcaccatttggttatccggatggcagtgagccgaatctgttcgcagccaatcaactttcccagcttggagctatatatgtggggtggggatgatgtaatgcctcaccgatattgtgccatatcgaaccaagaaacgaaatcagacgaccgttcaaactccgggggttcctagttggcgactaacagttgctagaacggccaggaggtctgaagggaccagctgggatctcggatccatcagctcaccgtgaagagggcacctagagtgaataagatcacaagctagaattctctaatttggcgttcaaatgctgaaatcaccggttctcaacctgtcacctatcaggagagttgcagtcatcggtgctggtccatccggggcagcagccgcggaagcactcaaacaggctcaagcctttgacgtgattcgagtcttcgagcgcagaggcgaggtgggcggcgcatggtatgtaacatggcacatctgctcatcatagactattgtttttaattagatgaaagtaggaattttgatccagcacccaatgtacctagagcagatcctctggtccatcccagcacagcagatcctccactagaaccgccggctgagctcccagcaactacaccaaagagctcgacagagagatggatcatagcgcctgtatacgagaaccttaccaccaacgtcaacgttgtaagatcatgcaagcgaaaccgagtgcatttcggcatactgacaccaagtccataggaaatcatgtcatatacctatcttcatttcactgacgtagacaaaacaccgctggcagaagaccatgatcccatgtttccttctgcagcccgggtgttgaactatattcaaactctccataacaggcactcggactacctagtcctaaatactaccttggaaagggcagtcaaacaaggtaatgaatggcgtttgacgttgagacgggcggataaggaaacggactactggtatgaagagtctttcgacgctcttgtcgtcgccactggcatctattctgttcctagaataccagatatcccggggctccgtgattacaaccgcagctttccagggagggcattgcattctaagtacttccgatcggtagaagggttcaaagatcgggtaagtcttgcccattcaggcttaagaagggagggtacactaacaatccggaccaacagtcagtcttggtagtcggaaacggcataactgcacttgatctcatccgggacctcatgccagtggcatcaaatctgacagtggctcatcgatctcccagctggatgtatcccacatccctggtgggggttcctgggatatctgttcgttcccagctccaacgcctggacccggaaaatggagactgtttcttcgcagacggaggacctcccttccgcccagacgccattatctttgccacaggatatcatgtctcattcccattcttatccccgccgtacgctagccacaaccatggtagctccctggcagcggattgggtccctggaacgtatctacacacattccatcaacaggacccaacattatcctttgtcgggctcgtccaaaacagtgtttcatttcggattttcgagtatcaagcggctattgtcgcagcatttcttgcgggaagattcaaactacctgtcttggaagaaatgcaacgctgggagaaagagcggctggaagaagtgaataacaactcagccctgtttcactacaacaaatacccaagcagcatcgagttcctaaaccatttgcatgccctgctgcaacagaccactgggcctgggttgcagcttcacagttggcaggatgaatggaccccgaaatacatagctggcattgaggagaggaaacgcagggttgagaacctgaagactctccacatcaccggaactgtattgtaactagatatgacagcctgagagattaaaaagttttttttatcctgcgtggtttcagtctgcaattttagctcacagggacaaggggtgtcatctacaacccttcagggtgggcttgtaggataagggtcggcggagaagacaaatgaacccacgtggtgttgatgagcctaaatcaaactaacaagatacattaaacgtattgagcagcattagatgaagctcccctagcctctcaataacaagaattatgctcggttatcgcaggcaagttgattaatacccacactaacccaacaccagtgtgccgcgtagccgtttgtctccatgtgtcggtgtcggggtggagctttgattcggacggtgaccaaaacgccgggaccctagatattgtgtcagtgtaaggcgggatttggtgattgaacgttacgttggaaagaggtggcaaaattatcaactcctgtagcgtgggttgacatggtatgttgcattggtattaaacgtgggtaccggtctttaaagacaggttcgtatatctattgccgatcactttcaaccttcaacgcctgagctactgctcagattcactgattaaggatggctatagacaagggtgtcgaaagcccggtcatgtccgaagtaggtaatgaggaagtcggtgttcagcatgtcgttatagaggaagagatttcaatcgatcccgaggaggagaggaaactactgtgtaagattgaccttcgtgtaatgcctcttctctttttcatgtatttcttcaagtacgcctccttggaaataccactattctctgtttagcgatctaacattgtttcatagttccctggatcggaataacttgggagcagccaaaacagacggcattgatacagacttgggattctccaagtatcagtaaaacctgtgctagacctctaccaccttttatgtttatctagaaccattgccaaaagctattgtattagctgtaggctcgttgaaagaattattgccaaacagcatatagtggccaaattaaaccacttttttcgttttccatatctcaatacacatcttccgaaggtctcgtgtgtttttagcgagagccggcgcacaggcgtacagattgtgtccaattacgaaagcacagatatagtggcaatctcaatctgattgttactacttatatagttccaagaggtgaacatgagatattcttgtcgggccaaggcgaaatactgccaacctggtccaatcattcgaagaaaagggataagggcttacctagcttacaatacatcaccctggccttttccatcaccatcaatcactggtgagttgagtctagaagaggatccgctaatcacttccacctttggggctatattcgcgacccttgccggcttaaaagtgccggcctagggggcggcaaggatggtgatttctaccaccacataccggtatcaggggtttcatcagcagggttgccccagcacgggagttgaggccaaacttccgcctctttctcttgtgaaatgccccgctaggagaaacgaaattgccatggtccgagcttcgcgctctaccaccatggtttagttgccactgcactctgcattcatcaggcatccccttggacgagcacctcgctagcttttttacagcggtagcttggcggcatctacccagacgactgcttatacgttgtctttgtctatccagacaatacaaccacaaccctgattgctctctgccaatatcagggttgatattctcattcccgccagtagttccattgaagcgtcaaccatgttagcatgctatcaacacgaaaatcaaacgagagatgagacagcaaatcaaagtaatagtgttatatatttggaatctagataatgcatatccctatccaaacaccactttgtgttttttatatccaataaccaaaatccaccctaaccactcccgacaacgttctaaacgaatgctcgcattattgacaaggcaggagctcgccgaatagagacgttgcccagagtagttccaaacagataagtcaaaatctttagacggtatcgtacaagcaggtattatcaagaatgaccttccctttcgcagtcctgctctccctccaaaatcactgtagaaccttcaccccgacactttacaggctgcggcggccgcggctgcgagagttgcgctgggggctgggaggagtgatgacgatagggggaggagtgggaggaggagtaggagggggagtgttcctcctagggctgagatctccaaggcttcggcgaccacggctgcgagagttgcgctgggggctaggaggagtgataacaataggaggaggagtgggaggaggagtgggagggggagtgttcctcctagggctcagatctcctagactgcgacggccacggctgcgagagttgcgctgggggctgggaggagtgatgacaataggaggaggggtaggaggaggagtgggagggggagtgttcctcctagggctcagatctcctagactgcgacggccacggctgcgagagttgcnnnnnnnnnnnnnnnnnnnnnnnnnnnnnnnnnnnnnnnnnnnnnnnnnntcctcctagggctcagatctcctagactgcgacggccacggctgcgagagttgcgctgggggctgggaggagtgatgatgatcgggggaggagtaggaggaggggtaggagggggagtgttcctcctagggctcagatctcctagactgcgacggccacggctgcgagagttgcgctgggggctgggaggagtgatgataataggcggaggagtaggaggaggagtaggagggggggtgttcctcctcgggctgagacctccgtcaaggcttcggcggccacggcttcgagagttgcgctgcgggctgggaggcgtgatgatgatgggaggtggggttggtgggggagtaggaggaggagtgttcctcctcttcccaaggcttcggcggccacggctgcgagaattgcgttgagggctaggcggcgtgatgacgataggcgggggggtaggagggggagtcggaggaggagtgttcctcctcttacccagacctccgttgacgcctcgtcgtcctaggccacggcggtggcgctgtcgagcattacgttgagggctcggaggcgtgataacgataggaggtggggttggtggaggagtaggaggaggagtgttcctcctcacctccagatcacctccctcgacgtcgcgggcctcgagatcctcgtcgtcccggatttcgagctcctcctcaacgatgtcgcgggtgtcaagttcatcctcgaggacgtcgcgtgcctcgaaaaggtagccgccatcagagatatcgttctcaccacgggcgacaagctcattgtcctccaaagcgtcggcgaccacctgttggccgaggccaaaaaggagggtcgagataacggaaacttgcttgatggaaaccatcatgaatgaaagattgctgttgaccagctaacagaaaactttacaaaggaaatgttgagatgagaaaaaaaggaaaagaaaattgtataaaaaggaagttgatgtgaatgaagagttcctttctgtcaactgcacgaaaagctcatcttatatagttcctgttgatcgttccagaggctccctttccagtactctagagagcatggccgaccggggcgaagtaaaaataactgtgcctgaatcctgcatctcaccctcgatcctttggtcaatacattcccgttgcaggattagcggcagtcgcttacttgcctccttcccccggcaatcgagtccaaagaaccacggtaagcgttttagcgagagtgctgtgaccgctcaaattacacccctttcctaggggaacagagacaagatcttttgctcactttgccaatcttctgtaaggttcgtcgtgaagcgttcagtggctctaggtttttggatctgccctaagctctgtgtttcagagaggccaacattgctacaggtatccacaggcatgtatgccgtttgccgttcctgcagcctgatgaacctatgaatagcatctgggaactagcaaactagtgcctcgggctatgcgaccaagtcggttcaatgctgaacccatgagagtggatcagtcatcagtccagccaaagaacgtcccgggggatcggacaagaatggccgccccaacaagcacgcgacagttcagttggagcggagtcacgtctggattggaaattaacccaactagctggaaacaggcctgttcctcaatccggcagccatatcgctaggcaaagttgtccaggttggcaatccacttaccgtcccggaccacatgcagcccccaggcaatagccaggaatagtggacaaagctgacgcctcgacggcctcgctaaatgacagccctccaaagtggtattagagcatggagtttgtatccagcaagcttcgagaagtgtttccctctcaacattttgcccctttcttctgaggcacagtctgtcaatcaactctgaaagtggaagctccgtctcgtgcaaacatgtatcggctcctacacctgcgaaccaggccgtaactgccgtgtccatatcaggaggaatatgccgatgatgatcctaatcatcctcccctgcattccccacccctgacaatgccaaacaactagtcccgacccccggcttcattacagcgtgtaaaggcgaaccgcttcgtggtggcccacaaaatgatgacaagagctgacgggattcattcttttgggcttcgcgtgttccagagtcgcatgtctctccctgaggagattagctactgacgtgatacaaatgtatcgggtctcgacgtgtttctcaggactgaacacgctaaacgcgtgcgtatatggaaaatgagatatcgtctggacgacactgaccgtaatgtaagcggcctggaggattcgacgcggagcgcgaacctgcgaaccctgctcagccccgaaaaggcgatcctagtcctggggggtgactagtatgatcaacaagccgctcttaacgagaatagtattggaaggctgaggctggggtcaaagaccagagagctcagcccatgccgacacttgctatctgcactaccctgtatacacatttcccattgttcgaaattcctctcagacagttctacaatcaatggcagacctttaatatgcatatgatctcaatctaaccgcgagaacttttccttcctcttcgaaatcaataggaacagttcagtgttaagaatattgtagtgtttaaaacgtagtataacatgttgtccacgacattcgctcgtcagtgatgatgagtttatcaagaaaagtagtgttaatatggggcttcaacgagtcttagtcgcgtataggaaagacaataatattagaagcaataaattcaagttactatgctcataactttcttcttgaaccgtacatgttacgcgattaggtctagtcattcgtgctcctcttcagcgacatatgtccttgttgagcgattctgcggagaattaataatatatttaaattacctacacggctcggtacgttaaaaatgcgttctaccggatgggtacatgaggtactttcgtaaatttctgcctccgcctgaggtgagagagtcgatgaccaaatcacgtgagctagcaccagacacttggaatctgatggcataatttgtaccctggctgtctttggctctccatttcgtgctagattttcatgaggataagcagccccaaacataccccggcaatacatcacacgagccatccttcacgttcccgtctaaggctgactgggtatcccctgtgtgagagagatttaatttaaatggtatggtcggcttgttcggaaaaatgaacctgccgagagactgaccagcttctaaaggaggttcatcctttcaaccaggaaggctttgatggcgccactctagaggaagagtcaggcgcaattttgggcgtcggtcaagtgatacattggaaagactgcgatcgtgcataccggaggaagcagactgggggggtttggttcggcatgccgaaggatgggggctgggtcaaggtcacgacaggctattctgtttactttgagaggggagcacacggactggtcaaaaggggggttcctgacagaccgctggaaccgcgcgcgatagccgacgggggttctgcagctctttcctaggaacggagaattctgaatttcgctgcctattctcattcctttgtggcaaaatccgtaccatcggacctcgcgcacgcctttgtcctaaatccgcgccgatcatgactgaacacacatcataagccaaagggattagcaatttccagtaatggctaagtatatacacgagctattgagttgaaggcacggctcagggttctatgagactcttccaactggggagacgttgtggcaaaaaatacatagatatctcaccattctagttagcacactcattttgtaacatccgatatcctccaatttccgctgccaagcaaggcaacttcttgcgacacggctgaatattggaaattatcatgacatgacgcctggtttggacttgttgagcacatcagtcgactatcccgatatctcatcactcgtgcagacagcctgattttcaatcatacctgtttgcgattgacgtcagattgagtcgtgctgtctttggttgaaatgccaaggctttcgatacaagagttgcaacagacttaatctggctaaggccgaaagattcacttgtttagagccttgaatcgtaaaggatccgtcacctggcaatgctatgtaggatgtaggaacctagctattgtggagcattctcattaatcgcctcgagagctctgtgcgactgttctcaatttccacctatagattctctcggaaaactaggtgcccttacactaccttggaagcagacaaatcttttgaacaactcgataacatgaatgaatgaagcaagcggccgagagcttaccacataataggcatatcaaaatgaaccctccccctttccactgaggtagggatagaaggcccgggttttcgcaggtcatgctgttgaacagttagataaaaggagccgtttttcgcggtctaggcagaaaacccacgcttttttcttcattcaattaagaccctaactcgtgactgacgagtgatttgactgactattcgcattgcctctgttcattgaagccggctgtgacctcaagaggcgctgcgacgagcgtttcaaatgcttccttcgtaagaaatccccctcttctcaatctgttcaatcgctcgagacgagtaaggtgtacgatgaatcacaatgcgagtgatgaagctgtcaactaacacgataacctctgtgtgccacgtgcctttgttgttgtggttgtgggtgtttcgtgtgtgtacagcttacttcaccatatcggggaagcactcgggcatgccttctatatacagccataatacaaggcaggtcacaaaatccccccacgaccacgttgggacgatcaggctcgttttggcaccatgatatatccgatacaggttaaaaaaaatacagaattactttgaaatagataagacgtaggaagagtaattacttgcttggccgagcaaggaagtcgtttgaattgcttgtacacggattgaaagttaagaacgatgatgaagaatggcttaactttgcaaccggaagtgtaatatcttcgacattggcaagtgtgagacctagattatcacccgatgaagtatcaaggcatggccccttacgatatgatggcgccatagccagcagtatgtgattcagccgtgtagttcttgaccaagaaacctcttatggcttgattcttagctggttggctgagcaggatattgagtcgttcatttttgaggcgatagcatggctggttttagcgtctggttaccaccattcattaagatgaatgcctccgcgttactcacagcacttttacctatctgatcaggtctttcaagtgttgagtactgctcagatctgtagcactatagccaatgtttggcagccctgattgatataaggtaagggggatcttacagctcccctaagcggaggcagtggatggatcctggagatgggtccttcctcacggctccctcacctaaagtcagccccccaatcaaaatatcatggcgtatttcctagaactaccattttatacgagcttatggataccctgttaaggagatgatttcagccgggggctgagtgtaggggttggatgtaagattccctttcagctttccccttgctaggtagacttcccctcccctgggagttgagccacaaccacctttgagcgactcgggccatgatgttttgactgggtggctggaatgtccctacttaacttatatacaagaggtgaacttagtccattgaggtcagtgatgagcgcattgataacatccatcttggtgacaccatctggcttctccatcacgatgttggtttagacatggatggcgacagggcaacagatgcccttgccggcatgcaaaagggttatcacaaacttggacacgggcagtgtagcgtcattggaaggctttcagcattctttgcaaatgagtgccgcaattgaatgaaaacttgtcgccaggaattagtagaccaagcgcgaggatgggtaaaagttgggctggaggtgaagcccatttgcacgtgagttatactttaatagtctcgatccaacagcgcgctgtttctcaatttccacctcaccattttttgggctctcaaataattcgttgtcaacaaaaatcgtggtcaataagcaagctgaacgggtgattggacaaaaacgtgcgattccaaagtcgcaagtaggaatgggttgatggattggcggaaatgcacaccgctctgcgagtttctttggctaaatcctcatccccaatgattaggaacatgctcatactctcaccaaacacttcttaaacataccctacccaaaggctgaagctgggatgggaagtgctcacttgtgagtgtagggtagttaaatatatagactaccctacacactcacgtgatcacgtttcgcgtcaacgatttcccaaatcttctctctcctatcaacaaccaagctgctcatcctcatatactagtttaggaaaaaatggatcgaaatggctttgaataaggcgcacggagacatagaaagacgggaaggggtggtcgctgcaagcataaagagagtttcgataatgcaagttggttaagcaaatggagggggagagtgaaagagagaaatgacagagccgacaccgaccgtgttcttggatatcgacattgacgtttttcgcaatgagaatttagatcaacagtcatttttctctcattacggcaattgattgtgatcacatccaaaggggttgcggagagtctgcctagctagggctgagtgggcagggtgctgtgggggttcgtctcaggaggcgcttacaaccaatgtccagaaattaatttgtgcataaccgcgacaagcctttttctgcatctcgacccacgaacgatcctgcgcgctttgattgtccattgaaggacaatggccaggagtcaaaaatagagttaacgagcgagggagggcgttggtgagtgccgcttgggctacagaagcgcgagacctgcagcaatggggcagttcaggggctccgccagtaggaaaccagccccaagcgcgcagcgattagccaagacacagcggtccaggtcgctggccagcgcccattggccccagccctacaggggccatagggcagatcctggcagcgaagcacccgcgcttagcaccttgcagcctcgatgcaacaggaattgatgtgctgcctcgttgttgtctgttggtgatagacgtgcagtggcttgaaaccgctgaatgcactgctgcatgccctgtgggcttggccttggatcttattggtgaatcacagttgcattccgtcaatcttgtcaatgcacctgagctgccaaccaacaaccaacaactccatgcttgagggaacttgccttcaatgcctgctgcctgagctcatccattataagggatctcattcccccgatggtttcttttccttctcgattcagatcacccgcaaaaatttctctctttcctacttctcttaattctgagcaaataccaccgtttcccatcagccagccctcagccgaattgaaatcatgcgtatcactcacatcctcctcttggccctcccagtcattgcttccacgctggaagacttcgagtgggatgatgaagaagaggagaccgtcactctcacattcacctcgacgagtacgaaatacgtctttgtctaccgcacggatgtgatcaacatgcacatgagtgcctccttcaccaccagcatcgtccccagtcaaactgcagccgccagcgatagcagtgccgcttcagcgtccccttccagtgctcaaccctccctccccaaagagactgtccaagacatctatgtcgactcagaccagattgttctcggccgcccttcgaagcaataatcgcaacctgcagcttacctcgatgtgaggcaaccctcacctctcacctcttttcgattgaataatttggtggacgcttcctgtcagctggccctggctgctgctcctctccacaactcccgaggtggccggtctcacttcccctctcaagcattgcgtcatcttgatcggtttgagtaccggtgctctgagctggttgttacatcaccctactttcggttgcaatcgttcttggcctgggcgacatccccacacacggcctggtggctcgggcgagcgtttttactcggcttgcctgcctcttattcccctttttaatcatctctgtatatatagttcgcctttgaaaaaaggcgctggggcattaactggtcgcacacccactattttagacctacttggctattggcagccatttgaaactttgagccattccatcagattgaagaaactctccaagagggatcaatagaaagctacgatatcacccaatgccatccattcgcgcactatcccatcggattgtgtcgcaattagtgtcttgagaaagcgtgttttgaatgttggtcgttcacctaatacggaactcccattacttccagtccgtaagagaagccaggaaatgttgactgacaacctattttccgtatcatattataatattaatcagacaaaaagagcttcaagtttcaaacccaaaattccaaagctttttccgaggccctcccttttccgagcttccgcgaaccccgacatgctggaacacactcggctccatcgcccacctcttgaggttcatctcgtcagcgacaatctcgataaaagagtcgccggcggcatggtgtggtggcgccctcaatttaccctctagcatatctagccgatgtgccggaaacgccaggccctgtgcacagcagccgtagttgttcatttctcggattccctcggacctgggtatgactgtcacgcgaccagccatgaagaacagcgctgtgaaggctatgaaccaaacgtggaatcgcacgatggaagttgtgtggcatggtgattgcttcttcgtgtgtcggccccagagggctcggccgagtaggatgatgccagcgaccatggcgtagaagagaaagacccgggggaggtatatgtgccactcctctgcgttccacccaaggtagagctcagtgtagaagagccgaaggtaaagccaatcatcgggagtgggtgaatcctccagtaggtgaagcgctctattcaatctcggaaaccaatctcgagaggcgatgatgtcgtcctctactagcacaaagtagtctgtcccttgttttcggcatgtctccatcaatgtggcataatccatctgcacatgttcatttcgctcggcgctctcgctaggcttgctctcgttgatgtatatataggtatcggcgctgaggtatttcggaacgggcgagtaaaggaggacctcgtcggccatgtttgagagccatgactggccgaaggcggggtttgctttggggttctcttcggtgatgaggatgatgatatggagtgactttcgttcgtcgggggacagagtgtcgacaagggacgcgatggttcgtggcaggaactgttctttctctcgtcctttcgtgggtattcctacacagatccgcgtggcactgtggttgtctaggtatgcgtagttcggatgtgtttcgtgctggaggtcaggctgttgggacgttgctgatgccgttagtgccttctgaatgaactcatcagcctcggactccctaatggctgaatacagtggcttagaggctttctcgtagtcgaagaagaaggagccgggatccctccaggagtaaagagcggcgagttggaacagtatgaaccataaagccgcaagggcaacgtccaccaacggtggtctggcacttgatagtcttttgagagtggaaaggagggccatttttaagaacattgggaaaggaccaggtgtctttccatgtgtgaagggagaattgagttacatgctaatcgtcgtgctcccttctagatttgaacataactgaagtacctcgggccattgtgttgatgattctattttagtatcagggctgacgatcactgtattacaatttggtttacaatatacccggattcatttctcggaacataagtacccattatcaatgggacataggtagggaacggtacccgcttgggacttttggttccgacatcgaggttaattctgggcatatttccagatctaactatttactcgcagcagaatttgccagaaaggggacaaaccggcctactggctcagtatgggagactagcgaggaagcgatggtggtagtgtgctcaagaggtgggcggtgtataggtagatcatggcagtgcatgtttcggatgttttaaccgcgtgaacacgagccctcaagccaaatacttagtctcaaaggtgaattccctcattcgtgttgtcctggaattccacgagctggctcacgcgcccatcaacggggctcctgcacccacacgaggtccataatccatcaaaaacgtgtcaaggccgaaggcccccaccacggcgctgtctttgcccaattaacaactcagaatgtcccgatatccgagcagatttcttggctggcatcttttgcggtaagtagtcggcgatcgcgggaggcagggcatgcatgtatcccaccgggaaaggctgatatccccgtaccgtagtgtttcagcatccttcgtcatggcatgcgcattcaaaggtcttttgcgggagctaaacgacatgttaaagctaaataattgcttatattctacaaaacgggtaaaaaaactgcaccagaggctgtaaacaccgaattaccaaggggggggggaagcggaaagatagcccctcggggagaacctgtgagcgtctagtacagttgagtagaaccttagatgttcacagctagggaaattagattgaaaaatttgagtcattgacacggtccacggtcaatcactcttattgactttatgcagctactgtaaggggcaaccaccgaagcccattgtgcaggcattccgctttcatccggtgaaatatcttgggtaattcgtatactgaagatagaaaaaactctcaagcacttttggatatgaattcagtatcaatattcatctcctcacgacctcgctgctcctacgtagtcaatcctgctagattggggctgtgctgtgtttccagttccaaagtaggaaatcagccgttctcgaatgaatcctcccgacgcgtcgttgtcgtctcagcaattacataaaagtccagttgtgggggggatcttcagtctaagctagttgaaactcttaccaagccatcaccaacactgacatgactagtagctctaaactggcacatcgtgaaggatgatggtggggagctcactcacgagaataaaatggggccattgtggcagtggcatgccaacatgcttaaagatggaatcgcgatgaagaaggctatttggcttgattgggctacagggttcgtcatcctcttcatccctgcagcaagcccgaaaccctggacagacagatcatcttatacgccggggctgtgcaacggaggcgagaccgccttcggtacagtacttattacctaaatatccgttctaatatacttatatatctaggaataaagttgacctggttgttacactaaggtgttaacatgtgaacactcgcgtggtcccaattctatacacacaatttgagtgctgtttgtaaatctctgatagtgatttgcagaccttaacaagcctgtcaaatggctcgggatatgttttcatgtctgggtcagactgctaaagtcgaccaaaattcgcatgtgtggtcgctgcactcgagtttacatcaaccagcctaatgtggcccgcctttatcccggtcgtcgcattgctcagcggtaggcgcctctcaatttttgattgtgagtgcccgttgtcaatgaaagattccgaccttggcaagtagaggacggatcgtttgatggtcgagcaaatattccgagcccgagcctctatatatgagggcgtactacgaggagaggggtctaatgaatggcccttgctgtagatcgatcagctatacctggtcgcccggcagtctcgacccttcggacttcagccaacgagcttctcccactccttgacctattgaccttacttctgaagcatcatagtaaaattgaggcctttggaagcttcttgctcctgaagaccgggatgatacccgtgagctcgtaatatataatgctcttattcttcttttcgccatctttatacacccgcattgcttggaatgatgaaatggttagtataacttcgttacggcaagtctcgctcgcgccaaagcttttgttggcgcatgacctaagggattgatagaagacgatagttgacccaaaggatagcgtgaagactttatgcccaagcactggatctgagtagcctgttttctttctatagatgtagtttcaacggtcatttattttataacaattaagactaagtactatacgatactaattcatcttattccagatctcaactcttctttctatcgattttcaaagtgagttggatgatgcagtgggaagttataatttggctggataatacgggacgtgacgtgtctgttgatgccctcagttctttacttagctgcgtctttgtttcccgcacaatcagctattcatttacaatattctttgagaatgaaagtaatggttaatgtgcgacttgaaggctttttactagatgaatgaaacggtatcgttagtatggaatgtctagtccaacctcaggtattatctagaactaccaacggcgcgcacaccgtgtgatatttcggtaagctccaccatcgtttctaatcgaattttttttttctttctacaaaagccttaaactaaaatgtttttacgactagccgcggctgtacacggtttccactattttacccccaaatcttgtgtttcctgttaaactatcaaattggtgctattttagctggacacatatttattgatttcccaatgaaattgctttgcaatgcagcaaggcaagaacgcaataggaaagaaaaatccgatcggattatcttaattacttcccggaatcatcctcacgtgcttacgttggtgtgagcctcggaccaggccagaagaatctccacctagcatcatcggccactcccttttccggctatgatcagggtttattgatgagcccattccaaatagaccaaacagacatgatgtgtctcatgtattgagaaatgagatcggcaatttcttctttaaccatgaccggatgcgacggaagcgcctcggataggccgttccgatcggttggtgctggaccgctggccatcggacataacgacagacgaggcctgcccatggtgaggttagaagaaatggcacagcagaccgggcttcttaagcctgaggaagactggactggcgtcagtgatccaaaaatgagacggagattacagaatcggatcaactaccgggcttggagtaagcatgctcacagtgcctgtattttacgactctttaactgatgatgaaccagagaggaggcagaacatgaggctttatgccaatggttccaccaatacaagctcagtgaatgagacgacgagtatacctctcataagtatgacagacaaacttatttccacactctgctcttcatctctggtcaatatcgaggctcgaatggatgacttcgaacgtgccgccgtccacgcctatacatccgggtcccccagaatagatcttcttttcaacttgactcaatttaacgtgatgagagggctgtttataaacatggcagctattgggtacaacccaagcctattcacggacgcctccgggaccgtctcggatacggccatctctcctcttactatcccgggggccacgccggcagtttcatcaatgacaagccacctgcggccaacctcgctgcagcttacagtgaagcatcacccttggattgacctgtggccatttccagcaatgcgtgataatatactgagtcgtggagaggaatacgatgacaccgagctctgccttgatcttgtggaaaactactgcggccccagcgggatgtctgggtttagagtctggggtgacccgtggagcccggagaactgggaaatcagtgaagaattcttgatgaaatggggctgggttgtcgccggatgcagtgaactgttgattgctacggactattggagggagaggcgaggagagccggcactattccgtctatttacataaaaaccagcccggcatcaccaacttattcgttgaccaagacataccgatattttggctttccagcatccatcttgagaagcgcatcgttgatgttcctcatggggaattcctcaatccatggcttgatatcgtgttcagccgccaactgtagcatttccctcgcctctgccggggatccgatgaatgatccagtcattttgacccttctcatgatcatatgagcctgtgggttgaaagtgacggagagactctcgggcacgccgacctggaccaatatcccgtcattacgcacaaggcccaagtaatcctggatgggcacctattttgttcagtacagccgccactttgaggaaagaaaacaggatctgaccttggaagacggtgtagtggacagaagaatatcaaaggatctaacgtgatccgaagcccagttcgactcctcgccagtcgcaatgaaatcatcggcacccatagcaatggcatcagcctttttagcggaagtacgcgagatgattgtcactttatcaccacccagagctttcgcccaaagaacgccaaagtggcctagtcctcccatgcctacgatgcctacgcttttcccagggccgcaaccgtggtatcgcagtggcgagtaagtggtgatgccgccgcacatcatcgtggccgcgtccgccgaggaaacgccctctggaattctgataacaaaattcgaagggcagcgatgatagagtgcgaagcctccataagcaacacccccgttgaagtgatggccgccaaaggtaccgacttgtttggtgcagtactggtcgtcgccggagtcacaatactcgcagtccccgaaacggctgaggcacgcatcagcctgggaaccaacagcgacgcggtcgccgactttaacatgaccagtggcgctggtgcccacacgcacagcaatgccagcaatctcgtgtccagcaatgcatgggtagacaatggggccctggaacaaaccggctacagttagattgacttgttagacagagttggtgttagatatcggaaactaacccagtgacccctcatcatggacaagtcgcttgcgcagataccacagtgagttacttggatatcgatatcagtctcttcccagggcttgggttcaaactcggcccaacgaaggttcccatcagctgaagcggggctgtctcccacccagccttcgaacttgtaatcattttgagccatggctacgcttgagtaagatcttgatattgggtgttgtgtcgagttacttttcagctgctcttgggtttgcttaaggggatgcgagttgacagacataacctctccttcttatacttgatgagaatttgatctaactccgattatgtccgcttaactgccttcccatgaccttttcttactcacttcctctacacattcttttcgtattgtcttcatgagatgtctatccccggactcttgtgacagctacgacatgggtaggattcgacctccccacttggcgctaagcaggttgcatattgtggggggaaaaggtccggagtatcgggcatggacacggagcaagccgataactataaaatattcttgcccttcttcctattgagatctagctgcatggtagctctagtttaacaattcctactatcacgaattctctagtaaagtggtacgagcagttcgttaatcttcactgcttgtgcttcatcttctgcctcctgttatctctacctctttctccagtccctccgtatcccggcatcacatttagagctcatcgcgtcccactccgtccgtattctttccctgagcgagaatgatctcctgtgccagatttgtccagaaagcacacgcaggcttcgtgttctggtcgtccgtgatgaacgtgaacgccgcctgaccactcggcatctgcaccgacaagacatccttgacatcatcacccgaaccgtcagccttgggccaagttggtgatggaacgccgtaaacacccgggtggcccagcttattcgggtcacccgagatggcaaaggacgcgaggtacgtctggtatgcctcggagatgcccgagttcacgagtcgatcggcgtagatgcccgcaaaaaactcattgatctgatccgtgctcttgagaagcaaggttttggcctcgacctgtgagttggcaaagagcgcaatcaggtcgctggcgtgtacggcgacttccttgagagggaaggcgtagcgcagcatgtaggatttgccagagtaggcggagaagaggtcgcgggtgttgcaggtgaaggaggcatcgcgaatcacaacgcctatacatctcttccaattaccatcgtagtccttccggcagtcgtattgagcacggatcttctgtctctggatggcaaggtcgtctccagggaggaagaggccgaggaatgtattaaaggtttcttcgctgttgacgtatttgggagtgaagctgtactgctcattccacgtatgggaaatgatggcagagctgaccttcttggagtagtgtcctgtacgacgacgctgattagttctcattctcctcgatgatatatacacagggcaatagcttctgaccttgggaaaaggcgattgttggtatggttttgacccatttcccatccacggagggtcccacggggaagagacctgtttgcctgacatttgcaaacaaggcttgatttgccacggtgagatttttcgatttcctaaggcagccgatgtcaaatgtctcgccacagccggcaagagcagagaacgtcttgtaggtcttgtccagcttgccgccgcccctgttatcccacgcccactcaaacgcagggctttgtacggcgattctgctgaagacggggtccttcttaccgtcctctcggatgacatggtgcaggatggagctggctcctgctgactcgccaaaggcagagatctgggacttgtccccgttgaccttgccaatgtgctcctgcacccagtcgaagagcagcgcctggtcatagaggccggcattcggctgcgcagccttctgcatgtagtcgcctgctagccagccgaatgctccaagccgatagttccccgcgacaaagatggtctggtatttactctttgacaggatcgcccggcccgtgtacagtgggccaagctggttcttgctgccatatgcaaaggcgcctccatagagccagacggcgacgggagctggtgcgtcactggaactcctggccaggacctgcttagggacgtacaggtcgaggaagaggcagtcctcgcccaccttgtcactggcatcacccgggtcggtgatgggtgtttcgccaccgaccgggctctcgaggcgcttggggtcgatcgggatacagttacgcccgagagaagggggctggacggaggagtttgtccacgatggggattgtggtgcgctaaagcgttcggggatgctgccgaagcggacattctcgaagaggtagatcttggggcccagtcagtgaggcaacttgggggcatgtaatcctggctacttacattgttatcatcggcgaacggtcgtccttcgtaggttccccatggcagtttcagtgtcggggggtctacagcacctaccgagttggcaagcctcaggacggagagcatcaacgatccaaagtgaagggcacgcatattgcagacgtgttctgggccgagttttacgtttagaagcgaaataaaaaaatcttctgcattcagtcagatcagaggatgtataaccagccgttttgaagtaagttctcggccatgctcagcacccatcgaaacatcacatcctcataaggccatgaatctcgattccctccacacgctatgcagacagggctaaagcaaccatccggcttactattgacaataaactcggctattccaaactcatgaaatgtgacaagtgatcctatgccggacgcccttttaggaagagcgtggttcacaagctgtatagagccgagctgagaattaagcgcctgggctagttgccagccactgtcggggtctgacatcactataatgccgggcaagtcttcggttagatgatattccatatcttccgggcaaggattggcatccatgggggagctgatggcagatcgatcgagttaaaaggagcttgctgcaggtgtgggcggttcggcgacggcgcgtgccgcaatttggcacagctaactaccgacggtggagtgtttctgcaggctatccagactggggtattacgcacagaagctgtaaaagtgctaggagtatggagtgtgggcttatgtacatgtggcataaaccgttcacaaagcgtgggtcagagtacggggtgcgtgccctacgcgtgtattctaggctcttatacagatcgaaatctaccgaagtgagtacctattctgggtgcctgaccctctcatgttccgctcttgtgcattagccaaaggcaatccagtcggcggagacggcatatagttgactatctagccacgtatccccatgccacacgaatccatcctggctgaggctatccgcatacgtcttgacgcgcaggttagctgaggaatccatgtcgatctcgctgatgccgacaaacagcttgggcaccctgtcgaagaacttggcggggaaattgacctccttgctgttctcggggatggcagggaaccatgttctcacgtcgagggtgctgaccctgcccgacaccgcgctgtcgctgttcttggggtaagccacccatgatgcagtagcgctatagaggatggtgtcaagccaggactcaatgtcgagatcgaagccggtcgccgtacagtttctggcgagggctcggacgcgatagttgcgggacttgtcaatgtctagggcactgagccagaccacgacactgggtggttcactgtacgcgccattggagaagctgaagtgcttcctgtacctacggacctgattctcatcgggctgtggcggcggctggaaatttcgcgtgttgaactcgcccactagctaggatgttagcatcactgccaaacgagactgttatgagaacatcgggaaagagggggggcaacactgggaaatactcaccctgataatctgagtcctcggggccgaactcaatccacgtcgccgtggcattgaaaagttgcgtgtccatccaggtgtccacattcacgacgaattcatcctccgtaacctctacagcctgtgcgcggatacggatatggcccgagttgccaatgtcgagtgacttcaagccaacggcgatgcgggggacgtcgtgatagggcggcacgaacgagacggccttggaattgagggccgtcaagggataccccgtacgaatctcgggatcaatgctcaactccccttggtcgcgcgtctggaacgggtagatcctcccaatgaagctcctatccgtagccgagagcttcaagttcataggagccgacgtgtgatcattggtccagtcggcagggtagaagtaacacatgatggagttggcgtcaaagtcggaccgctccagggaattgatgctctcccatgtgttgatgatctgcttctgcgtcgtggtcttgtcccatccgtaccgggccaggcagtctgactcgacgcggggcacgttccagtcaattttccaggcctggtgctcgtgcacgcatccgatggcgtgcccgaactcgtggactatgctacggcagaactcagactccctgctgtcatcggtgaggctgccgtaattcatggtcggctggctctggtcagggacagcgacctgtgcgcgcttaccgacctgagaccaggtaccaaggtcaagcgccttgggatacagaggattcggcctgtcgctagatatgagtaagggctctcggtgccgacgcaggtcggggagggacagtgtggagtgacgcaccatttgaaggagacacgaatatctgcgtcgccatcctcgacgaagcgaaagtcgatattagcatacctctcccagatctgagagtattccctaactttctgcttgagctttggagtgccattgaggaagcggaccttgagctttttgcccttgggccaccagaggttgctgtcagcagccaaaaaggccggctccccttctcgggagaccaagttgccgccaggcagggagacagactctgccagtttggcatcggccgagcagtagggaaagtcagggagcgattccgtagtcatgttgattgatcgttgaaggtctgtacaatttttgaatatatgccacgagacgagacagaatatgccaaccaggcgaagtgtgaccgtcaggacactgatatagagatttaatacacgctcacctaagtcgtaggacctgttaaatcgacttatgggtatgggtgtatagagagagtcccgacgtgccttgatgcacttagtatcattcagtatctttacctgcctatggtacttcgcctaccgcacgcttattgaatcccaatgcgtaaaaccatacaatacaccgggaccgccctcagcggcagcatcgatgtacccaacatttgacgatcgtcacaataagtgcggccgttgtgtcgtacgtaggactacctttcctccctcgccatgaagtcccgaaacagctgtacgtgcataagatgaactcagatatcacagcacagcagtacaaacggaaacgagcgacgagacgaggtgaccggtcaccttgagctaacactaagcgtgttcaatagcgacatgtagggcggctgggattggcgggctcagccttctcctagccgcgtccgtctcatgcggcccgacgccaacgcaacgctaacgcaagaggcctctggacgtcacaattaaacagcgcagacagacattcgatactgatggggaaacgatccgtagcgtcccaatagctgaaatgtgcatatatggagtgaccacctaagttgggaaaggaacgagccgagactcctagctgaagagaggtcattgacgtcaataggattacgcttcaacacatcatgccttagaatgtgcagctacggaactgccgagatgcagctcgcggggcaaggagttcaacgggatgacaggatgccgagagtagcgtcattgtccagcgcctagacaaggtgcactatccgaatgtctcacgcccctggctcattacgccattcaccgtggtcgagatcgtgatcttgcctaggttggagcttaggaactcagagctgaagcacctctctgtagactagcggagcttccactgccttcaattcgccacgtctgcagataggttatggcctcagtcgaaaaacgagacgagcttgttgagtaatgtaagcgaggcataacgcaagaacaatgctgggaacagtgctgcaccagtgacgaaaagattgatcattgtcaaagaagtgcttgagggactctccgtgcaagtataaaaggagcctcttttcccttcaagtcctggcaattctcatcagcaaagcatccaacttactacctactcctcaatatcatcatccaactctattctctggtcattgatttccatccttcaccatggctcagcagactgtcggtaagtagagaaacattcactacacaagactccaagacttgggtactaataccgagttttcaaggtgctatcatcagcctccaagccccccaggaaggcgacaacatctgggaggcccggcaggttgaccaggtcctcaacctgcctcctggtgacggccagggccgagtaaccattgactggagttttggtcctgtcaaggtaaaaggactctttctcaactctgggcatgcgacatcctaacgatgcgagtgtatagatcactggctacgtcgacaccaacactttcgagattggcgttagcgtgagcatcctcggtattaacgttggcaacatcttcggaaacctgaaggatggtgttggcgttaaggtcgacctattccttgccaaaggctccatcaagatttacctcaagaatggcaacgaggtctgggtccaccttgacatcaaggtcaagtttgacggaagcttcgatggtgactacaagatcctcactatctaggtacatagtcatgggcacatcaccatgagctagggaggaagtagtattaggatttaatgatagttgaaaatagtaaatctaacaagaatgagcttatcaactactccttgtttttccagctgagattttagtgagtgttaagtcaattcctttttcttccccatggtgttatgtctcgcttggagaggtcggtatcttccactatgccaacagctattgtccggccgccgagatgctctagagtcttgcgttttccgattagccagatatatagatgacaatgccacaactcccttggtgaaaagggctggatcattggagattatgtgactgtagttcaattatgactggatttggtttgtaaatcaatgggctaggcatgatcttcggtagcttgccttcggtgcttgaccctaccaaaaaaaaaaaaaaatctactgcgggaagtctttagacaacgcgtgataaaatatgttaattctagcaattcggttattacagcccaagtccctggtttctattgttgtcagtctgtgcccatgggaaagcggcttatgtaatgcaaagagccaaaaaggcgactgatacatgggcacccaggtgcccaaacatcctggcgcacccaggtgcccaaattatatcagcaccatccaccggcccaccattcgccatcgacgcgttcgtatcgcctttacggtaatattaactttacgaataatagactatacggtattccctgacgatattctcccccctgagggtatatataagtcccgtgaatctttattagcagctattaattcttaggtaaaacctcgaggctatatatttacgaccgggaaatctctaaagactcccaatagctgtatctgagttatatttatatataactgaaataagctgctaccaagtatatctatcgatcgagtacgctatacctcgagtcgacgaactggctgtaagttcttagtcctggctaagcagtctttagattgaaattcttaggtattaacctatagaccagataaagactgtaccaggtataattatctactaagtaaggacctatctgtatacccagtatactgctaactagaggagcaagatataatgattatttctaatcttataatatctggtattactccttaagatatacagacctatgcttataagtatttggatatcctgattacttaacgggatctctataactgttttataataataagaagagatcttcaggaaggccagagcagtatttacaccttggttaactaattgtacagcgagggtttctagtgttaagtctgattagatacagacaatcagctaatagctattttctttatatacccagactctatagtgtacctataatataacccggatatcctattattagattgtacctataagataaacaagtactatatactgcttcttgatatagttagagttgactcttactaatgatctttctgtattacatttgcttttctctcaggcgaatcagaagaagactacttataggtattacaataccttaaatcgctctattagtatgatctcccgtctgttattttaacggactagtacctagctgtaataaatactgctgctatatagttctctttattaaaagcactgctttatctttagtatattaataaggctgttctttagtactataggccttcctttatataataagttgaccaagcctccgaccagataagtataagggtataggaggaattttatatctgctggtatttgattatagtattaccaaacaaagtaattttcaacgaatatttagtaaagttggagcttatatataataataagtacctcgacttagtaggatatattaaaatatactggcttgacctatataaggagataattattaaggtataggtagataagcacttgtattttggtaatatagctatattgagataggtagtatatttctttaatattaaataggaattaattcctatactccagggctgaaggtatccatttgttattaaagttatatattaagacttctacctttaatctttttaatatctagcaggtaattaaatacactattataaatcaactaaaggagcttgaatatatataagttacttagtagctgcgaatcccccttgatatttctggagtactatttaaagcagtataaggctgggttttatactataccttgcgaaaggtataagagtaacagtagctactttaaaaactatatcgcgctccttatagttatatctttatatctttactcgggctgctgtattcgtatatactgaaacagttagaagaggagaggcagagccttttacttgaatatttctatctatattagtacttaaaatgagatatagcttagctgcagccagtgctagaaccggatcgagttacaagccagcttctatagagctatattcagccggagataggaacaaggtataagctctctggttttaagagagttgaaggtactaggagagccctaagtaaatatagtaaatattatactgttagctatataataaccttaaagaactatcctctaagattttaagacttattaagataggtattaaacgaagagttagatcaggctttatcccggggagttactctacagccggattcagttgctgttcctattagtttaatcgagcaggccccgacagcccaagaggtacctttacctagcagggcggtcgaagtctctatagaattcaatcagcactcgccctttattacaccggtactcttaattttattatcccccgtatccagttatcgtaatatctccaatatattagttataaaccactctattggctttccgttagaaatttctaacagggggtctctcgttgagaagataccagctctcagcaaactacccttataattactgccacagtataactccccggaggctatatatcagagatatattaccgcaagaagcaagtagtttgcggtataacctgccggtagtattaagactaaccagtaatatcataaggcgataaagcttccgcaaagatacgataagagaagctataagtagtatctagattataaacagatatcttagcactatataactttaataggatccagagaataaacaaaagaagagcttatagtatatctagattggaataaagcagaagataagtatatagaggcccaggtcgctagagagatagagagcaaccccttcggtagtaggagacgaggtgtataagatatctggcgaaggatagaggaggatatcaaggaacaggaagccttatactcagaaagtaataaagtaggtcagtatatcgaaatcaagttatagatttagtattagtatgcgaatcagttcagttcaatcttcaatttcagcgatgtggataataagtagttcgaatcaggggctcccgtacgaatggtgggggcaggtggagggtgctgacataattgggcacctgggtgcgccaggatgcttgggcacccgggtgcccatgtatcagtcgccagccaaaaatatcacattagtcatccacagcatcatcgtcatggctgcctcctccacctcgatgttcagcggacgcgatccatagcgcggcgtacttcattccacagggccacgtcccggatcttgctcacctactattgacaacaagcttgcaaacttcacttcgacttccggccgggcaggagattagcccgaccgcaaccgcgacagagcgagcaagagctagaaggcggaaaggcccctccctccgcccacaaccatccccggcttcgacatctcccgacgtatccacgtacgaacgatcgaagcgaagtgaataaaacattgcatgggatatttccccggggatacttgtagtcttcaaggcaacacgcgcagcggtacactcgtgcatgccgtgggaggcagtgtgtggatggccttggagcaaattacagagcagggcctggcctaacttggccttgtcatggaaatacactgctgggccgcatcttgtgcgctcgatatctcgtgcgacaaacccgcaagacaccagagctgcggaacagatacgaggggctccgccgctccaggtattttcattaccaatgctatcttcagaaggagcaggattccgcccgatggatgtccagctaccggtactacgtagtgcatattccgttcatcaagcgtatggtcttctagagcaggtcaaactgcagggagggttggccgatgccgggcaagtaagtagtattcttgcgtggcctcttgtaaatcctcgggtcctctcacctcttttgtcaccaatcattgcctttctcttatgttaggccccggaagacatatataatgctccgcggatcatgtataacgtcccttcaagtggtggggtcctgctggggtagctcgttatgatagtcgtccatatcaacccgccatgaagaggcatgcaaacttcaccgcatatcagcctctcggggccacagaggttatctgttagcggcacacccaattgatccatactcgaacactcctaagaagattctcaagtgcttcatgcaaaaaaaccggctcgtcattggccctcccccaagctccaaaaggaccatccgaactgatgtaatgctgtgtgtgtgtgtgtcctcagaacagccgcgtgacccctgtgccgcgcttgcaccatcgccattgtgagttccctctcacctaattccttcccgaacgcccattcaagcttgttttttacattggtaatccgtccatccacacacgtccaatcagtcagctcagcccttctcggccaggcgaatcttgtgtgctcaccgaagcccggggggtcagcctgccctcgattacgccgagagagccccgccttgccatgcctttcgcgccctacgaacaatgggggatccagccttttgcatgatgccttgcatgggctctttgtccgttatcctggatttggcggatccctgaggcagtccttatctcggtcgtttgggagagcgcccacgttgcgtcttttagtgatatctgggagctgggtcgtcctggacgaatggcaatgggtgatctggcggggaaaaaagtctggagacgaccggcagtgttgcatcggatgctggtgctgtcatgttcggatccactgccctgggtagagagatagcgaatattgcggagaatggagggacgagccggcatctggacaagacacggccaagtcgacaccattgtccatccgttcggcccggctttacgtaccacagacgaggtcgagccactccgggagcacattcggtcaaccctgatcaggtcaggtaacagaagcagggtttgatgcctggtttggtcagatgaggctttgctgaggagagattgttggatgcaactctgctctttctcaaccccacaccttatctgtatcgttggatgaaccccgtcgtcatgcatttcccacgacctggtgggtggtcttgtctggcagaggcgggataagtgtttctcgacttgcagcaatgcgttatcttgaacatgtcgataataaattaggtaacggatatccaacttaaaatcttctggccatccccgactgcaatctcgtccatgatggattctcgggccttgaatggggaagggggcatgccgactaggcagactttactgtgccgccacggtattcctcgtactttcaccgcacagtcatgataaggtctattggtaatgatggtgggtgacagtcgttgggcgagagaattgtacgagccggggtgcgagagctgtgattctgggagtataaagaagccgttctcagcgtggcatctggccgtcactcgatgggcaagctcattcacctcatcagtgacagctcaagcagacgatcttgagactcgccatcatggctcctcacagatactcttccctctttgccgcagcggcggcaatgcttgctctgggccacgctgagcctttgccatctcgccatgccgtgtccttcaggggccctttcgagattgaaatgggcggcgtacataacatcaatgttgagtacactgatgatgtagatggcgagcttgctcttgtttacggtccctgtggtatctcgtccatttccgaggcgcaccaccaggttggtcgcactcacattggcagccaccctcttgccaagcgtcatctagactgggagagccaacgtcctaccaagtttgtctggattattccctccgaggtttcctcgggatgccttcatgctttctccgatggcatactggtagggcggtcggagactatcgaggttaccccggcgaagcttcgccgccgaggcaccttcgccgacgtcaccgatgccatgggcccttggtttgatggtgtcgcatacctggaacaaaagcagccagacgaggcgtttgttgccagtgtcaagaacaagacatttggtatcctgggtgctggaatctctggattgatgacatcagtaagtcctccctagctaccccccacggcgcgcatcctattcattgcacgttccgacttactaacggcatcaatgatagctgcttctcgacgcagttggtatcaagaaatggaagatcatcgaatcctccgaaaggctcggtggaagaatcagaacgcactacctcaacaataccacacctgaggagggccagtatcacgagctgggccccatgcgcttcccttacaccctgaccaacagcgacaccaacgagacctacccgttcatggactcgcagctggtcttccagctcgccgagaagctcaacaagctgaacggcggcaacaaggacctcgccgtcgacttcatcccctggatccagaacgcggacaacactcccatcacgaccaagttccgccgcccggacggcacctggcccggcaagaacgagatcgcggcaaaccccaactgggccaccaacacaacctactccgacccagcggaggccgaggaggccgaggaggccctcgaggccttcaagggaatgacggacgagaagatcaaggagtacgccaccaacgtgttccgggctcacaagcaggccgtcgaggagggccttttcgacttctctgagatccagtacctccgccaggtcgtcgggaccaacctcaacgtctccgacgaggtcgcctcgtccgccgccacgggccccatgtgggagtacgacacgggctacttcctcgccaccgagtggaagaccatcaggggcgggctgaaccacctgcccaacgccttcgggaacatcgtcaaggaccgcatcagctacaactccaagatccacagcctcaggtacaacagcgacaccaacaccgtcagcgtctcccaccgcccgaccaagggcagcaaccccctcgacgccgcgtccaccaccgagacgttcgactacgtcctcaacagcgtccccttcaacctccagcgcttctgggacctccccccttactcgagcctgctgtcccgcgccatcgaccgcctcgagttctccaccgccgccaaggtcgccatccagtacgacacccgcttctgggagcacctcgatcaccccatcttcggcggctgcggacgcgtcaacgccccgcgcatcggccagatctgcttccccgcctggcagctcaacagcaccggcccgggcgtcctcctcgcctcgtacatctctggctccgacgccacggccgcctgcgccatgaccgaggagcagcacgtcgcctatgtccagcgggccgtggtcgacatcttcggcaaagtcgccgaggacaactggacgggcaacttcgcgcggcagtgctgggcgcacgacgagaaccacggcgggtcgtgggcgtcccccgtcggatcgcagcagccgctgtacctccccgcctactggcagacggagctcaacaccgtcctcatcggggagcacacgagcttcacgcacgcgtggatcttcagcgcgctggagagcgcggtaaggggcaccgtgcagctgctgctcgatctcgggctcgtcgacgaggccaaggagattaccaagacgtggatggcccggtggatcagggtttagtttctgtgatcgtgtgattggagtgtatatgggtgaaaatgatgagggtacagaaccatgcccacggtgacatatggataagacatctctaatgcaaatagttagccaacaccaatcaatccaaagccaaaatgcaaagcccctgaagccataatcatctgatccgcacgtcgtcaaatgagattcgcccgcacatatcacattgacgaatccgccgtagtgaaaacgcacccagatgcaaaacgcccaactgggcagtaggacgactctcatcattggctccaacatgcatcgtctccaggcgatgaactgaccttccctgcacctacaggcagtggcaccaacagctgctgcactgcagtcattcattcacgtagctaatactgtaaacaccgagctgcgaatcgtgcttctctccaacgagctgcttccccccccccccagagtcaacattcattcccatgccgtaacagcgcgctcgtcaagttttaaaggcatgcttcacctgggaaataattccacgtggagttgacgtcaaagatcagcaatcagcagctaccgttccatcgcaacgtagctaatcgctcctcaatgctacccatcgagggggggatgcgccctgacagattggtattgggggccggaggatttgacagcggatgtgattgtgagaccatctcaatgcagaccgaagcatgcgagcctcagacaggcgccgtcgcatcatttgcctacagcccccaatattactccccgaccgtgttggtcggtgttggctgttggttgctcgtgcactggaataaaaatagccccctcccctcctcccaatcccctcatctctctctcccctctcctctcctcaagttctacgcgcacgggctgctggtccctctttgcgggcgcgcacgaacgctcacttttccccattacaccaccgaaacgcacccccagtctcgtatcacaggcgcactggaggattacttgaaactcattcatatagtcatttagaggcgggggtcacgactctacccaatgcccagcattagctccaggctaccacccattctttctgtctgtccgtccgtccggtatgtacacgtgtgtgtcaaagtcgctatgggcctgatctttttttttcatggcaaatcatagcaagggtaagaatgacaaatgcgcagcaaaaaaacaaaatgaagcacaaaacagagcaaaaggaaaaaaacgcgagttttcatcaaaataaccatgtaaccgtcaaatgctaatgaacaccgctgttcgaaataccacgtctgtcgtctaaccattgtttcataggagaagaaaaagaaaaaggctgagaaaaaaaaatgacaaagaagtgaaagatatgcgggaagaagaagcaagcaaccaaaaagcaaaggccgccgttcagcttctgagtccttccagcttctcgagtttcacatagcactgtttcggcttgtgcgtcagtgcctcgatagctccgtaccccgaaagttctgagctgcattgacccatcttgaattcccatacaaggagcgtcaccatgatgcgcagctccatgtagccaagacggcggccgaagcacccccgggtgcccagaccaaatggcagagatggcccggaagtcgagtcaaatgtcagactgccatccggctccgtcctcagccaacgctccggcatgaatttatccatgccatcgggactccactggcgcaagccaacgggagatttcgaagtttggcatgatgcactgcgaaggcgctcatccacctggaagcctggctcggtaaaggaaggcccacggttcagcatcaagagaatcgtatcctttgggatgtggtggccgaaaagagtcgtgtcggtgttggtttggcggtcaagaatgggcagcgtgttcgccagccgaagtatctcttcgatgacggcgttgaggtacgggatgtgtgtgctcgtgatttcatgggctgttggaatacgaccttcagcagcggctgcccagtgcgcctgatgaagcgcggctcgcagcctgtcctgagcgagctggttgtctgagagaaacttgaggccccaaagcattgttgtgcttgaggtatcatgacctgcaacaacgaagccgatgatctgcattcgagttagcacggattgcgttataattggttatttgacggtgctgtcttacctcgtctcggatcgccggggaccagtagaccggctggcggccttccttttgtgcagagatcctctccctcatcatcataagatctacagctgacttcacccagcgctcgtcgtgcagattggtctccatgttgaggcgttcctgcgccatgtccacctgctccctgagaaacgcgttgcgaatgcggatatgtcgtgcctcagaaggcatcttactcttgaaccaccagtggagccggggacatgggctgtccatcaactcgccagtggtattggaggcatgcagagtggcctggatagtctcatgcaatggcccgcgtacaaactcgacgacgccctgttccgtggtcgatgccgttgtcgatgcgacatcataagccgtcatcgtctccacttgccgtagctgtggcggcacagcgcggtgtgggaatgcttgtccgaagctgaattccaataccgagtccagcgcggcatagaagatatcattctcggcagaaaaaggtcgtccgcgggcgaggcgctccttgttggaccacagccgtacaaggttgagcgtgcttgcgtaaatgttgggagcggccacgtccttgaggaagccgggcagcatgagatcctgcaacaggcggcggtgggccttccacacggggccggtcttctgattgatatgatggcccggagcctgtccgctgaagatctcgatggtatagtcggagcggtcccattccttacgacgcagcatgatgtcctgggcctcccgatagtccgagatgaggacaaagggcttagagaaaggccgcaggaatacttggcagatgggtcccgaatggcgccgactttgatcaagtatccaatccatgggaccgttctcatctcgcagcatggcaggaaggtctccaagaagggaggaggcggcttctggattatacggaattccaggcagaggtttcgggagaagggagaggtagaggaagtacaacaagcctgccgcgagggcgacgatgcccaccgccgccagcggctccgagagcagcagagcagctagagacgccatggcatggcctaaggtgtggaaagtcttagagaaaatgctggagggagattcttcctgagcagtggttcaaatgtgaaacaggtatggcccaggcaattggaacagtgcaagggggagagggggcaagacaatggagcgcttttgggtataattgatgcgaggtgatgctgggactggaaatgaacaatcttgcgggcaggccaaagatatatatggatgaagaagccgcccaaaaagaaacggggtaacgtttattcaatgacttgatcattgaaggggataggagagagaagggggggtgtgagctatgatgaatccggccggtgtgtgctcttgacccaagacggactggactgggcgacttcccttcacaccgcgacactggttcgcttcactcattcgagaaatgggagagtggagtaggccctcttcatctcgcccacgaggaacgtgccagacgaaaatgaagaaaataggttggagggggtggcctgatggatttgctggaccgagttgcaggaaaaccaagcaaggcgacttgggtgagcaaacagacaagtcacaaaaatgccctcaacctgcaaggaaaaaatcccagggccatgtctcgggaaggaggtgacatggggatggagcgaggaggaaaaagaatggtcgaatcaagtccattaaccgcaggctgtgtgatttattgatactggctgtcgccaattcacggctatccgcacatccacccttgctgtgtgttgcatcaagtccatctgctactgtcgtagtagattcacaagccaagcagccatccgatatcagacgccgctaatagcagggagccgagacgaccgagaatgggctcggttgggatgggatggatggtggcagtgaatgggtcgtcgcatcgtcgcatgccatctggccgcctctgctgctggctaccacatcagcggggccgggggccgatgcagtatctggttgcccctgtcaatccgtttcttttcatgttgtacttcaaacatcgacctggggggtatttttttcacaagcacatgacggtgaaatccgtcctctcgtgatctttgtagctctcgcacgttgtcgtgcatggggaaggcgctaaaaatccgcattccccttcagttagtggaagggatctttgtcttgcgcgcaaatggggactgtaggggaggtgagagtggaagggtgatgctcaaaggaaaaagcaaagactgcagaagaaggaaaaaacgagcccaaccccgggccacagcatcttactggatcccgtcccttgctatatttttcccgatggcccccttcaccatgcgtgtccccgttttgtcggtatcacattgtgctgtttactttttcccaattcttctgcttctcaaaccggtctgtctcgtctcttctgcaagggcccgtgcctgaccccgtgtggaactgttctggaaatagcagtctgtcttgtcttgccttgtactggtcgagctatgcgacactccccctccagtgtccccaaagcctagctcgttttaaggttgggagagcaaactcgaagcacttgggcgcctagcatgctgttcaggtgcaaagttgatagtaggaagacgcttgggttggcagagctagtgccaaagtgtcatggttgataggtgcagggcccatgaacgattgatgggcactatcccgctgtcaggcgcgtattgtgtaccgcttattcgggggcctggaagatgggaggggcgccacctggctcgttacggagcaataagacaggtagatatttcatcatcgcttgccacacaggacctgcagtgacagcacccaatagcccaatagcccgtggcttcggttactctaacactgccgacgcacgtccggggtggtcaaggtcgtattggtgggggccgaatacccatcccctagtcccctccatctggtagtcagatttcacctactgtgtgctgaccgggatagcctgccatgggcgtcatcgaatcgtagaccagagatggctgtttccaattgagtcactcggattttcagttttctccttcttttcccgctcctcttctcgcctgaccgaaggcttagctggaaaaacgagaaaattgtcatcgtatgataggtgcagagggaaaagagggggtaaaacacggtgatgagttgtcgtcaacggcatggtgcatcatgctgcctcggtggatgggttttgattttgtggtttgtatgggtgttcggtcggcagggcattgggccacgccaatccaaaacaacgtcaacgtcgtattaccgcgcttcagatgcatctcatcttgtgcgcccccagtgaagtgcttggtatgcgaaattgtctacggaatttcaccgggggtgctgcaagatggatgcgcatagagcgaggagtggagttggcggttgaattttctctatccttgtgcctgcgcttttctttttctccccttgcctttctcctgtttcctgttggagagtgtgttccgccttcggagctggcgcaaagcggtaaatagggcagggcactctcctcgtgacgtgcgagagatagccccatctcatgcagcggtggaggagcgagcaatgggtgaggcgctgtccgtcgggtcacgcttcgacactgcaagcaagcaggcggtcacgatagcgccagtgggccaggccattaccggcactggcatggcgcgcgcacacgcccagatacgttgaactagtaaatcgagaatgcgaacacttctttaaggtgcaattcaggactaagaaccaacaaattgtggggtgatcagcaccgacttgggtagccatgtacgtgcgtccgtaggtgccacctggtgggaaatacgacgccagatgggacccctctccgcgcgtggcattgtaccaacgtgatccaggtcctctcgtctgggttattaatcaggcagaggccaacggtccatgggcaaagcagagcacctacctaggcccttcatgattcccagcacaaccttctgcgacctggccatgaatgtcaccccgttcgactcggcacttgacggcgcgggccaacaactgccgacttggatccgtagtgaaagtctaaacatgacgcacggccgttcagttcttttggtcatggcacatggcgccgagactggttctgggcaatcgtccaatttagagttggagtaggtgctgtaaagggtgggtggtggatgtagtaggcgcgcgagccgcagcaaagaatgcgcctgtctcggccgatcgctgtatttttgtgacggatctcccggtggcgtagctctgaccgctgttatgtgtgatagcacagatggtgattgcaatggtaatggtttctgtcgcgtcatgaacttgggaagattagaaaaggactgttaggctgccgtcgctgttggacatgatgggaaggtgctagcctgttctggagagattggaaggcacgcctcctcgagatttaggggacggcagcctaccactacagcacgtcttgcactgaaggatatctccattggattcaattggaccaagataaacagaaattcctcccatttcggaaggtggcgacctgctgcagcgttgacatctcgttgcacagcgcgttgggcccgtcttccagggtaggtaggcacagctggtgctcgattgacttcgacctcgcgagacaactcccaacatcaaccaacccatcaccataccatcacttcgataccattatagtccgacctgacctggttccagactcggccaccgcccgcaagctcgacaacacccggcttctcgcagcaatgcgcgccacgaatctggccccttgcccgtccctaaaccccgatcttggctccttagctccttgtccgcctagcccgaagcttcacaaccttcttcctctcggcagatggcatccctcggcagcccagagatgatctatctggcacctctagctgctagtctcggcatacgttaggccctcgaggccctttagccagtcgccaaccccacaccacgtccaaccttattctttgcatcatcgttggacctccacaatctcgttggcacttccccgcaaacttgattgtttgcataccagtagcgaccccatccacgaccacctgagcacccatttctacatcagatgatgcctttaagttgcaatggccagcgtcttgccagatgcggaaacccgcggttacctatctacccgcaagtcgcgcataaagttgggtagctgatggagccgcaacacccatctgccgagtcggccctcccatcacgaccgtggtaatcagcttgtcgccaacgaccagtcagtaaccaccctctcgaactatgatgcatgaaaccgggccatcgtcgagataggcccgcatgccagatgatggaattgccgtcgcttgtgaatagcctcctcctcacctggcgatgcaccacacccactggccacccgtgtgcttccctaggcatgaaccacgtcctattctcggcccaattgattcctgacgcctccatggccagcaaacttactttgatatactttggatgccgctctgtcatggccatgtatcgcctctcactgcctatcctggcctaccctcgagatcgtcacatgagtgacctaagccaattgttttgacacggttacccgtctgaaggccggtcgcagcatctacgacgctgcatcattccaccaacagcccccatgataggcaccggccaaaggggtttattttgccgcggcctttgggaacaatcgatcccatgtagtcctgccttcgggtgcggggcatcctaccctccactggcgtagctgttggcagcctggagtcgtttccaagagttaccttgatgttactggatactattaccttggcacctccaaaatgaggtacttcatgtcggatggtgcctcataggtagcgcttcgaggtatccagtgtcgcatccttcagcgacgcaatcaatgttgctctttggcggacgttgtgcaagacctactcctctcctcgcggaagagagggaaatccatccggcccctcccactcgagccaacctttgttgatccagatgcattctagccccgaaacagaagatcccattggtgctttagatcggttcacacactgacccagtcgttggttgctcgacccattctcttttcggcctcacccatcatcagagagcttacttgacggggcttcccccatagggccgcggaagtctgcctagaatcactccgccttctgtacattctacaaggcggttctgacatcatctcagatagctacgctggcgagtaacccaacagattaccatccctcatcgctggatcttatgaccttgtctgtactgtctcgccaataatcaatacctactttgccctgtatcaggtggatggaccctagtcgatctgatgaagaggcgtggtgagcgagcgagttgcgagcggtttcggttggttcgtcgcggaccgcggcctacctcagaaccctggcgtcaacttttggctcggccattcatcgttgacggagatatcacgcctacacactaaatttcccggtagctccatggaagggaaagcttgtcaggctacaaaccaacgaaatgtgtgcggattgagggagcatacctgcgataccatgaaactgaccctgcaataatccgaaacgaggtaaaccagatgggagcgatatgctttccctggaacaaacaagcgttaggcagggacgcctggcctgttccggcttgggaagcggatgcttcagaatatcagtgtgtgacgaaaattgttggcagttgacgtgagaacaaagtgagggaaacaactctgtttgttccgtttattcactgtcacaatcagtatgtgtttcagagagacatcaaaagggaataagtcattgtttgccctcgctcgaaattccatattgtcgctatgaatactcatgagaacaatgaatctagtgcttcttgtgctactgagcacctagcaagtgagtttccaacaatgcagggtgaaacttctgcatcggctgagttcatagaacgcatcggcacaattgatttaaattgaataaacgtggtttttatctcacgcatcccagaccgttggcttccttgttttcaccattcaatcgaggctaaaattgaagggatctcgaagggtcccccaacactcaccaataccaatcaaacttgttacgcagagtccctcccatccctcaaaacataattcaacaaattgcatcaatcacgcgcgatggtcgcgggaacaaagaggggaaagcggcctcgggaagatgactccagccctcccagaagcagagccaagcgagctcgacggagcaagacacagacaactaaacaagaagagtcgccatcccccggaacatccacgtctaggtcgtctcgaccaccctccccaactgccgagttatgtgcgccttatcaccctaagctcgcacaatggcggtgttgcgtgaggggctgtcggcggcgttggctcctcgccgcccggaagtgcctacactgtggacatgagagggattatagatgtcaacatttcatcgactacagtgggtggaaggaacgtaggaagtgggaacgccaggtactcttcatcgagaacttacgggcgtcgggcgactacgattacggggtgaggctcaccccgacatccatcttcgtaccaaaagaacgactccaagaagtcaaccagcagctgaagagcatggagagtgagaggctcctgctgttgggggacggacggcacaactgcttcacggattgctacgtgccgaggcaatgcaaagaggttcagcgtgaactcgccaggcgcacctcgtccctgtccagcgaggagaggagccagtcgccgaggcctgccatgcccgattcccccaaatcgccgccgccctcggatgacgaggacggcgaggatgttgggtggattgatgttggagacgataaagatgcgggttcgccaggaacaagagatgaggatgccgacttggtacgccctcgtcggcgcttgccctccccgctcttgccatcagatggggcacctgaaatctacgaggacgaagacgccgcagacgggcctgggcttggatcagatgaggaggttacaatagaatgaggaagaggaagggacgagatgggttgggctaaatgatggcggttctcgctggtggaacagcttagctggggctggctcccagcatggaaagaggcagccaggatgagtcacgatgaaagggacgagatttgggaggaaaactgaaatattatttattccacacgcaacttgcgcaccatttgactcgaaaacatttgattttaacattgtcgtctaccggattcgccaggcccaccagccggtctagatattaggtagctccaggtcaagaccatcccataagtactacacggctcgtgatgctggaagcagaggggacccgcatcctgtgaacctgtcctcaccgcatcttgcaatgcagatccccgggcatctgaacctatccaaagatcctttgcgacttcgacagaccacccgcggcctccgcatggagcctttcatagggcggccatcaataaaaaaagaaacgaggggggtaaaaataaaagacacacaaacagcccagcaacccatcaatccctaatttcgtgaccttgcaacctctgaccctgagagaaaagaaagttgaaaagcaaaaaaagaacaaacaccagtctcaaagaggtctcatttcgtttttatttttctcaaccctccagggccttggccttcttcttctgctcgaccttgaggagcagggcgcggttgatgtgaggcaggacaccaccgaaagcgattgtggcacggatgagggtgtcgagttcctcgtcgccacgaatggccagttggaggtggcggggtgtgatacgcttgaccttgaggtccttggcggcgttctgagggggaggagcgttagcatgataaacaaacaacaatgaggggtcgaacaggaacttacgccagccagctccagaacttcggcggtaaggtattcgagaacggcggtaacgtagacggcagccttggcgccgacgcgcatcttgctctgtgtcctgttcttgaggaatcgcttcacacgaccgcaaggaaactgtgaaatggttagtgccaaggttgagggtaaattggcgcacgggcttcatctcgtcatcgcggaggggtcatgagatcaagggcgcaaaatcgtatgtcgcgaggctgtagctccatcaaacgtcctggtcgagcgccggtcgttacaagattccatgtcgcgcaagctgggacgcgacaatgccgatgaattctgatggtggtttggtcgtcgtgaggggtgatggctgtgcgtcgagccaacgcgtcgaaaaatcggtcggacaggagacatcgcgggggttcttgtcgttgggtgacgaaaggcgcgcaagctccctcagcctggtgcgcaagacgagaatgaagctagaaaatcgagaaaaaaggtcaaataaaagaaatcaaagtcaccgtacctgaagaccagcgcgttcggaatggctcatctgcttcttgggaccctcagcagcgcttgtcttgccgccggagctcttgcccccagatgacttgcccttgcctccggccattgcgacgagaattcgacggaagtgggatagagcacgtgtagcgtcgagcagcgaagatgaatttcgctacgaggttgagcgattcggaaatagctggcggcggtgtgcgatgttcgtgggcgtgaaagtggtgcgtgcacgttgttcggtgtagtggagaggttgcggctggcggtggtgaatgtgggagaattttatcagcatacgtgacttgggcgtcgagttgttgttgttgttgtgcagtgtgctgttttcgggtcttcgatgcctggaggctggcgaggtgacacgcccacggctccctctgcaacgctgaaaacttgggcgcaggtcgctgttggctggcattttaggcagacagagcaaggcagctcttcggctggcccgaggaaactccggtggcgcttgctgtagctgattaggtaagacgcatgcggaggtcagacgaggctgtctgaagaggaggtccaggaagccttgggccaagccagccgtgctgcctttgccgctggtccctagatggctgattttgaaaggagggctggtccatcaagtaagtttccaaatcctcccacgccgtcgcatccgagaacttgcttggcgaggtcggagggaatggcaaaacctactttgggagttgaggtaacaagatggtctcagccccaagggcaccacgaacttgctcatcccgcatgttgggccaggtgtatacctacatattagctcttggatggtgtgtttgaataaaacggttggccaagcttgtcgtgccaacaaattgctcgtccctgtgaaggagaatttcgagccatgattttgaggtaggcgctagtgatggccattgagagatgctgtgacgcagatgccacaagccaccagccatattatgtaatgatccttgtggctgcactttgcacgccaaccaaaccgtctgatctcacacaaatgcgagagtatctgtaatcaaatgttttgttcttgtgttttcagggaaaatgagtactaattactttcagagaaaatggttcgaaccggttttttttctgtgcattcttttcctggacttttctgaatttttaaattccatgcaccattccaggacccgagctcctctcctcagtaacagttcggcttaccctacatcgagcccttgtaggtacttacctctgttgaaattgaattcactggaagcaggctgtttatacatattgaagggctcatatatatatatatatataaggtacttttgtagcttttattgtcatatgtcttatttactaagaagaggagtttatgatgctgttgctcgtctttgagaatgtcggaacagaactgagttctcgagagggagacactcccctacttccatctgacttgagtattagtattcgagctttccaaataaatacccctggaaagccccagatatatccacgcgaagatttaagatacggtattataaaaaaagaacaaatggtgtacattcacttccaatttagctacctaggtaggtagctaacgatctattttccacacttaattattccgttagaagaaactgtagtttactccttatgttttcgttccatctcaactgccttgaacttttgcgtgatactcgtgatggcttcctccaccggtagccgctccatagagcttgcaccatagaaaccatgaatgcccgttgtccgactaaggacgtactcggcgtcttcggggtttgcaatcggccctccgtggcacagaatgatgatatccggattgatgcccacagccgtgtcgcggatctgctgaatcaactcgacggactcatccagcgtcttggttgtggccgcgccaatagacccgctgctcgtcaatcccatgtgcgcgacgaggatatccgcccccgcgcgaaccatcttctccgtctcttggatgttgaacacgtacggggttgtcagcaggtcgagctcatgggcgcggcggatagcgtcgacctcgagatcatacgacatgcctgtctcttccaggttggcccgaaactgtccgtcgatcaacccgacggtggggaagttctggattcccgcaaacccaaggtctttgagctgctgtaggaagcgagggatatcgcggaaggggtcagttccacagacgccggcgatgacgggtgtgtgcttgacgacgggaaggacctcttttgcctagtcatacccaagttagcgctgctcactctttgtgtcaacccctccgaaggcatttattaccatgtcaacaacaatgtcatttgcgttgccatagggcatcaatccagagagagaccctcttccggccatccggaagcgaccgctgttgtagataatgatgagatcgcccccgccggcctcgatgaacttggcggagaggccaatgccggctccggcaccgacgatgggctttccatcagcaatctgagccctgagcgcctttagaatttcttgcctgtttgttgggggcgtcatatttctgtatctgacacgctgttacggtcaaagatgaaggagcatggccaggcagaggtgaggggaatgacgtgtaaatacatgtagctgtggggttccattgtaatcgaatctcatgacaacggcaacatcttcgcctattatctccataaatctcttttctagttgcatggtgacgagtaccacagttcactcaaatattgcaaccatttcttcaaaaaattatcatcttgcacaaagtatcccgctggcgtcaagatcccttgctgcggttacaatgaaacgtaagaaacaaagcaagtctactcaaaccgtcccctagaggctttcggtgtgttggtaatcaagcgaagtatcatatctatacttcttgaaatgccgggttcatttattgattgaaggacacaaggtggtcagctcagacgcattgctgcatggtgacgtgatatctgcgacactagccggcactctttggtaataacaggacagtgtataaagaggggataaattgcattcaaccttttcacccattccgcctgtcaccacaactcacaagccagactgtcgttacagcatacgagccggccaattccgaaatgactgccgtggtcgtcttcgggacatgcgacaccaagcttgaagagcttgtctttctcaagaatgctatccgagaacgcaacagggacggcacgactcgtttagttgatgtcggatggcgggattgcgagcatgaagagattgatttctctcgatcggacttgataaaggattatggcaagggggctgatacctctgaaatgccacgtgccgagctgatatcattcatggctcaatgcgcagctggccttctggaagaactctacaaggaacaaccacttcatggggtcgttgccgcgggcggctcaggaggcacggtgctggcctccaaggcgttcagaagtgccttgccaattgggttccccaagctcattgtgtctacggtggcgagcggagataccagtgtccttgttggcgagtcggacgtgacgctcatgtactcggtggtggatgttgccgggatgaatcgccttctcgctgggatcctaacgaacgctgcgggaagtatctcgggaatggcggcggcgtataaagcccgcaacgaaacactaccgcaaactgaacccaatcccaaaaagcgtgttggcatcaccatgtttggcgtcacgactccagcggtaaacgccattaagaagcatttagactcatcccagcaaatcgagacttacatcttccatgccaccggccatgggggtaaatcgatggaaaggctaatcaccgaaggccagcttgatgcagtcatagatctcacgaccactgaggtgtgtgacctggtgaccggaggcatcatggctgcagcacctgagcgctttgatgcagcagtccaagccgagatacccacgatcatatcactaggggccttggatatgtccaactttgggccgaaagctgacattcccgaaaaataccgtgagcgtaatttgcacgaacacaacagtctaacaacccttatgcgtacatcggaggaagagagtgcggaaataggcaggttcatagccaagaagctaaggggcaccaagacacctgagaagacccagatttggattcctctggggggagtcagcatgctttccacccctggcggagtttttgaagaccgccacgctgatcagatattattcaatacgatcaaggaagaacttcgaaatagcggaattaagaccgtggaagatcaacgagatatcaacgatccggggtttgcaaaagatatcgcgaacgctctcatatccttgttgcaactgaattgagatatttccttgccttggttcatattttcaagacgttttcctcgacttggtgaaacaaatgaccttcgactgtccacttcgtaggaacattatctcgattagtggcgtactattgatacctgctatcttccagatattacgaatctcaatggcctaagcgccactcaaccgaaaaggcatatttgaacagtactaacaacatagaataaaatctcactgtatttaaccctcctatattatatatctattaaatagattttacttcaatcgtactgtgtctagcgagtcatgagatcaccatccggtatcttgttcagatatgatctaccctataaccagtattgaacctaagccgacgggcggtgtgttgggccccgagtcagctgagccactgaggtagctctgcgaagtgaaacggtattgagaaaatggtcatgaagattgagagaacgaatcagagataggagggcagaagatggatccgtgggggtacggccgattctacggaacattgacgacgggatgacatttcgttctttgtccaaaggcggggcagagcccctctacgtgcttcatttctgagacattgtgatcgaggaaatgttctaccgctcttcgtaagcaggcggcgcccgacctaagcccaagctaagcccaatgatgggtgctatcttggcaaacccggcgctcatttgtcaccgtcgcggccggtctcactgggggcgaagtgcggctgggatagcccactggcaaattccgtgttcaaggttgggtcgacatgtcagaaatccgagggaattgtcaaaccaggggctgttgacaaggctgccgcgtgtcggaacaccatgtaataataagtaagcctcctcacaccgtacctccacgccgctctaaccggggctagaggtggcgcctttagaattcagtggtcggaagcccgtcctgaagcttcttctctgactcgggcctactgaagagacccaagggtttcccagacgctggatgaacgtgaacgcccgtggatggaggagcagagcgttgttccagttgtctcgagaggcggcgataaggtataagagatttcaccccctgtcgagacacgtctccccaccgcaacgtcattccctctctattccctcaggactgacagcggctagcgctggaaatgactcgggtttgaaccgctgggtggaaaagacccctgattctggggccgattcggcggcagaccctctcgtggcaccgtccgtgtaatgtggtaggctaccagcgaaattacctacgtaatcttgcgtgaaggatgggctgggcatgcaattaaacccttgccttagtgcaaccctaccatctgaccaaaaatgcagcctccgccgccatccatcccaagacgccgcctcgcatctgtgcattttcacgcaaagacagatgtcaactcttctctgagctgtgagcgccgccgccgatgcgtcgctgagtgcttgccatgctgccggccaccctactgccgctgctgctcgtaccctcggcgcgggcatggaccgtcccggcctacatggacctcgccagtccgccgcgctggacgacggacatcggcgatcagtacctggtcaagaatggcgaggtccaaaaggggttcgtcaacgcggaggcgtcctgcatgcataagccggtgccgactaatgcgacgcgctcctacttccccatcacgggcggctcgatccgcttcgactttgttaatctgactaccgtttcgaccggggatgcttttctcatcgatatgtacttcaacgacgacccgtggggggagaatccggacttcaagtcgggctcgttgaagcggatgcagtggtggaggggcttcggtaacggcatgagctgccatgtcccgatggatatgaccgagcgattgacggatcctacgaatcaaacggcaattgcgagtttagaggggctcaacgtgacctttgcccttcagatccaggactatagaaacaacagcggcgtattcgagcaggtcgatcaagtaagtaccggtccacttgggcaaggacactcttcgttatgaactcaagtactgaccagcggtagtgcgcatacgtgacgttgacatcaaacacgacgttgataccaaacgacaccctctcatcgagggaactaactgaagaggagatgtgtggcagagtgaacctagacaagctgggaaccacaaccacggtagcagctactccctccgccacctccaagactgagtccaaagcggccagacaacttcccatatcacttactgcatggtgtggattatcgacaattcttgtatatttaacgttttgaatgagtcacgacgggcgtcatttgttcatatgagggaaatagcattgcataacttattagtttagttcgacattattggattggaaaggattccaaagggaaaataccatagaccagcagaagaagacacttctgacagacggtctgatcgttctggaggagcatagcatggagaaacaatccatgccgccctgaatatctcaggttgtacagacacagtggatgacggagtaaattagagcattatagtatcaagtcacatagaaacaggcgtcgtcctagtatatagaataccagtacattcagtgatataaattgaatcgggttccacccgtccgacagtttagcctcggggatcgacatctagacagaactaccatcgtgtttgtgctagttgcagttcagaagtgaaattagcccgcacctttaaacgattcttgatccttccttccttctagttcgttggctgacacatgatcgtccctttcgtcttaaatcactagttgcataggacgcttttatgttgcgatatgaaaacatggattcgcatgttacgttacatgttggttgacaagcacacacacacatctctctttggtgttgtgttttgtaactggctactccagctccgtattcccaatttggacaggctatgataagcagatctcttctctatattagaagggaaggagtagatcttgactccttttgtgatttcacattggggatactagactgaaatagctctaaacttgccgacatcccgattccaattatttagctgagtcatttttacatctgttttcgttgctaattttccacctattgttttttagtgtctgatggtttttaggaccgccaagaggagaggaaagttggaaaattttaaaggagttaaattccgaaactccggtttctgttactcacaggattagaacaagtggagaactgaatctgctgcccctggccacggaacccacgcttgcagtgactattgctgctgtggcgatatcagatctcctcctcattgattgtttctccaataagtactcagttttgtctagtgatcaaaattttggattgttgcaaacacaattgggtatcctagcttgagatttattagatgcttccttctatatgcaaaagtaatcaccaaaagcaaggtgaccaaagagatctgaatgcttgaacgaagtaggcactcattttggaggcatttggcagacccaagtttgtgttgatggtttcgcgaatcaatgctaaatccctttaaaagagttcagggaccgcacaagtacaccaccattagcatcaacaaaacactttctccccggcccgaatataatctctgggagatccctccaaggtacaattctccaccgacttgtttgtagcagactacaagaccaacgaagtagactgccaggacctcggactggtgcctccactgtcttgtagtgaggctagttatgccccccccactgacatgactcgctcggtgtgtttgaggaatcacctctagccaatggtgtgagcttgcgagtggtgtcgtgtgccctacttggaccggtgacctcggctcgtggccggctttccaccatccgccacccctatcatgattttaccagtgacaaccacgcagtcagtgattgtcaatcgcaataggatcttccagtttgaaggccaaaaatccctgcaagagcttactagtttgaagacacgatccaaatcgtggcgtgctcggccctcgttcagccagccgtcctgtcaggcccgccaacacgtggttaaacgtggtgtgatggatcattagagttggtggaggtagaatgcgtgaagtgccgggggctgggcatttgagacccgctggatctttacctagatgtatttctggagttgagattctttacgggtgcacgcggtatcaagctgccagcgtaggacggacaatttcatctcgccaaaggtgccagtccaaacatcagaatgtgacccaatcatctggattgagtccacggctcggttaaataacccttatttctttacgttttccaatctcgctggcgatctggagattcgatcggcagccggggtggcattagcatcccggtcttttatccctatcaagacggatctagatcagtattggaatcgcgaagagcctatcgcctaaaaagacgctccgtaactccttgatccgcatgcgagaggcatcttggccacacgatctccacatgagttcgtccctgaaagattgaacctggatcttgaaccaaaccaagtggagggactcgtgaaaccacgccggaacactaggccatttgagagcctagacgaccattttcctagctactgagcactagcaccatcgcctgaagatgccctcccggagctttgcccgttctagtcaatggatcgcagtcttcacggcagtacttgcggtagtggccaaacgagtgcagtcagtgaatgtcattccctgcttgctctagagccatctgcctcggtttcattctcacgccctattcataaggcgggcctgcctcccttgtattcgtggctctgcttcttgatgagccgtctgttttgtttcactccatatatcacatttgattttgcgagctgtcattcttccacaaatcaaaaacgtgaccccagctcagctgcatcatcatggcccccgaaagccgcggagatcagattacgggtgttgccattttctttctgtctcttacgacttttgcttctatacttcgcgtttactgccgaggatgggtcataaaagccttttctgtagatgactggcttgcagtcgctgcccaagtccgtctccccctgcctcaacactatatcagcttccattaacagcgaacgtctagatcctcttcattatcttcagcgtatatgaaattaccggtgtccactatggcaccggccagcataactcaaagctctccactgaagacttctccaaagcgatgcaggtgagggccggcaggcatctgacgcatcgtacatgaactaacatactggcacatagatgtggtggacctgtgagccgctttacgtattgaccaacatgttcatcaaagctagtattgccatcttcctgttacggatatgtgttcaacgagcacatgtcatcgccatttggatcgtaacaggaatcacagaagtctacagtttgttcttcttcttgctgttcattctgcagtgccgacctacctcgctattctggcttcgatacactgccgaccctcctgcggggagctgcttggacgccaagatcgttcccggcgcgttctacggatactctataatcagctgtatcacagattggaccctgagcattcttcccgtgttcatggtttggaatctccaaatgaataaaagagtcaagatctcggtcattctgattttggctgccggtgccatgtaagaacccctgcaacccactttctgtctcgcattctcttgaatgagacggtctgccgtttcaagtacaccacgggctaacttgcgtaaacagtgcatcgagtgctaccattgtccggcttccctatctccatacactgaccgatatcgacgacttcctctactccacctcggacgtcgccatctggtcaaccgtcgaaaccggcctgggtatcagtgcagcaggtttcgccactctccgaccgctgctacgcgtctttttgggcggaggctcctctgcccaggcaggcgacacatccggccgacagtggcatcggaccggcagcggcaaaaacgcaaccactgacatatttgagttgggagatcgctccgacaagcgcatgggcaacacaaccatcatcgagcacgacgacaatgaggacgcaaatgatagtaaacttgatctcgagggccagaaagcgagggacaatgacaatggatccgagacttcagaagcgcgtgtggacgactggaacagcagccagtctgatcttgctacaaccaaaccaacacgatcggcgaatccgtggagtatcacagtcaagaagtcggtagttcagacgagggacgggtgagaactgccggaaacgagtataaatacgagacggatgagaactaccggccggaagggcaccgagtcaaagccggatgtaacccaccggaagcaggcgaggcagatcacggatgagagccctcgggagggctccatggatgaaacggatgaaatctgtcaacgaagtatatggaataacagcacttatacataataataatgccatggagcagcatactgatataacccagtaaacatgcttggaatgcccatcttgattagtgtccgtaatttcaccgtcttgttgtctcgtctacgcttccaggcacgcccggtcccttccatgaatgcctccactcggcataaggtgggatgcccgataacggtgggtggtttgtcatacgcactgccatagttggcgccgcctaaaacgcatgatgagcagagcatgtggccgggtcgccatggacccaagccccgtttattcaagaaaagacggatgctcaagcggcactgtggagttccatcaccccacgccgtggcctgactggtgttctatgcgagaaggctaatgctagaaaatcaacctgtacgtaactgagtacacttccatattcccggcatatgggagatatccgtcctgtcgggaagtataaataacggctggctttctaaagatgcaaggagggccggctatgtattcatcgttatatactcttgatatattctcaccttattacatctcttcgtattatactatactctacccataatgaccaagtttgtcctcactggcattgacggaaacctgggcagtgttgctgcccagtacgccgtggagattcttaagcccggggatgaactcgtgctcacatcctataagctatccatcctagatcccaagactgttgaggaatggcgagcaaagggcatcaaggtcctcgaggccagctatgacgacctcgaaagcctcaaggtagcattcgagggcgcggaggcagtagccttcatctccacctggttgtttggtgaaggccgccgccaacaagcccggaatattgttaatgtggccaaggagatcggcgtgaagcgggtctgctacacctcctttgttggagcgggtatccaggccgagaaagaggaggatattcccttcctgccccgtgaccaccatgctatcgagcaaatcatctacgcctctggtctggactacaacatccagagaaattacctctacgccgataacattcccactctgtttgctccctcttggaagttcagtggtgaccgttggcttacaaacacccacggcgttgccggcgcctacgttgcccgagaggactgtagccgcgtgtttgccgctcttctcctcggaaagggcgagcctaacaaggtataccacgtaaccggtcccgaggccgtgacgaacgagaccgtcttcaactggatctgctcccagaccggttacaaggctacctttgtcgacttaccggatgaggagctgaagcagtggtggcacgagaagggtctcccggatgacttcacgggtgacttttccaagcttcctatgaagctctgcatgggagatttgttgtgctgtggtgagatggtggctcgtgggtttatgagcgagacgagcgatacggttgagaagttgactggccgaaagcctgtgccgtttcaagaggctttgctcaagtacaagggccttttccctcaaccgtaatgtcatgcaatgataaatgtattattatgaatgacaaatttaaccttctatttcctatccgcgataaaatatagcagacgagatattgtagtagttccttcctcgatcgagttagatgatcatgcttacctgatgctttgggcgtctatacgaaataggccccatcattctacatctatacgatctagagtctctaaaccagtaatttactcgtcagcgtgaacactctgggcaccgccatcaatcttggcccaagcatccaccaaccaatcctcaggccgagaaagctcaatatccgggagtagctcgttccatgcattgttagtagccttccaacagccattgtggatacccaatagaacgcccgtaaggagagctccggcagcactctcacgctgctccacagggatagctggatgggtgactttgggaagccaggaggccttgacggccccggctttgaggtcatccaggctgagtttttcaacctcgaaagggccacctagatggaatgtcgattagcaaagatagacgggaatagggtgggagctgacgtacgaattttctccccaagggctatgagctgggagatagtgatattggagccgacaatgccaccaaagactggccattctccttcataatcaacagcccgcgcaaccactttggccatatcttgggtagttgtgagggtaatcgtgtcatcttcatggccctctagggtgagtatccgacggcgatagaagtcgattggcatttcgaaaagctcgacgtgcttggacgaccggaaagggaaggtgagataattggtgaaaagccctggaatgaatagcgaatactcaatgacctaccagagagggcgttagctcctatcagtagaaaatccgaaatatatgaggataactgctgaccaaccttcttatctttgtttagttcggcaaggtagttcctagtatcgtttttaaaagagtaccaatgcatgccttcaaagtgagacctgaccagcaaaggtatgagcgaatggcacatggcaatgatgtaacgagcacaatacttacgtagcccactcgctgggagcaaagcgccttactccggctttgacagaagcatcgatgaggattcgctgaatcgagggcttggcggaacctgggttgtaaggttcagcgatgaaggatagcatagtgtctattccttccaagacccgtgtcaactcgtcaacgttgtcatatgacacctgggcccatttgactccgggtgagattggagttgccggggcctcctgaaaacctatgttagaggatgggctctgggaatgaagtcggaagagaaatcaacaaacttttcgagacagaattaagatttcatgcttattggcagcaaccaaagcatcaataatctctcggccaacatctaaatttgttaataaaaggtttgaatagcaagggatagatcccctattttatatgaaacatactgcctgccccgccagcaattgcgatgctaaccatgatgattgacttcggcgagtattgtagaacgtgatttcgatggaggattatctattgaacttggacggaaaaccaaactattcaaggcggactggatcgaagacagagatagtgattggtaatggctctcttcataacggagtctacagtgaccttatttatattctatttatgatgtattatatggatttaagtcccggtgttaggaatcccactttcgttttgaagagaataataagggcttccaccgatcagccgggtgtataagggagagaattctggttgttccaatacccatgagcggtggctgagactattagtaatacctccgtctcaccggcggaggaaatgtcaacctccacacccacatccacacacacacacacacagcttgggaccgggagccgaggaggcgggggtcgactcttcgcaaccaaccttggcaatggaacaggtagcttcgattaacccagatgatttattggctccggccccgaagcgccggaagctccgcaagggcacctcgagctgttgggagtgcaaacgccgcaaagcccggtgctccttttcgacagctgatggagcagtagacaacgcttgtcatggctgcaagctgcgcggcacaccctgcatttcccaggatcttccagaccagccggctcctggtgggagcaatcgccatcttgtggacaggctggcccaagtcgaagccctggttggtcgtcttgtccaggccgctgaccagagccaacatggagattcatcattatcaccacctaagaggcagcaacaaccccatctacctgcagttattggcgaagagatcccaccattcttgactgactatccttttctgttttcctctgactattctggggtagaaactccctttgtatgtcttgtgcctttgaagcattgagtaccttgtgaaatgcatatacatgtattcagatgcagctaacattcggaattccagaatactgctagggaagagcaaagccatgttcatacaatacggccaaacattactcaaacaactatagcagtaccagccaaagaaaacgtccctttgacggaaagttctgtgacttcaccaggaaaatatgattccgtgtgccgggagcttctctctgtatggccagcggcacgagacatgggaataattctcggcgcccctgtccacacttctgccatgatgcgtggtgcaagcctcacccggcccgtcaatctcccggagatggaactgccgtcaccagagaccttgcttgagctaccgtctccttcatctcatccggtgttgatcgcccggaaactcctcctgctagccacattcctccaaggcataccgccagcatcctgggggcatctcgaaaatctcagggtaagccgccaggaactcatgaccggtgccgtttccaaggcccaccacctcgtaacctccaacgacgatctggtcgcatcaatagagggtatcgaatgcctcatgctcgagggcctctacgaatcctactccggaagcctccgaccatcatggcttgcgacacgccgtgctgtgaccattgcccagatgctgggcctccaccgaggtattaggccggcgtccttggcgggggcgagcttcaagcctgatcacgtctggttccggttggttcagctggaccgctacctctccatcatgttggggttaccgcccatgtctgttgacgacagcttcgccaagccagagatcctggatacttgcacgccagaggagcgaatgcagcgtttaaactgcgctgctgcaggccgcctcctgcgccgcacgcctacagatgcggtagacccagccaagacgaaggagattgataaactactccaggactcgtcggcatcactgccgcctcaatggtggctgacccctacattgtcctcctgccacggccagatggacacgatccgcgataccttgcgcttcaacggccacttcatgcactatcatatgctcgttcacttgcacctcccgtacctcctacccttggaaagctcacgcgactacgactatagtcgcatggcagctatctctgccagccgcgagattctgtccaggattgccagctttcgcacttttcgaccaactgggtactactgtcgcggcgtggatcttctcgccttccttgcctgcgcggcacttgggcttgctcacatatgtgatcatggccgtcagaggactggtgatggggagtttcctttcctcgttcaccagcgactgagtgatcgcggtttgctagaacacacactgcagtacatgtcagacatggcgcgcgtgagtgaggatgccattggatcaatggtggccactttactcgagcatctcctagccatcgaggaggacgcagcaaccggatctagctatacggtgacttcgtgcatggactctgatatagagagcgaggaagagaccggcggtagccatttcaaactgagtgcagatggttccgtactgaccattcatcttccccatatctgggtcgtgaagatcgagcgcggtcctggccaaagcagacgactcccaaccaaaacaagccgtaattccacctcaacatccgagcccgcgcaatctacagctcaacgtcgaccaagctcaaatcaaacctggcaagtgcgacagcaatccaaaatgcttgacagtcccatcttgcaaaacccttctttggcgcaactcatgccctttgtcacgcgtgatcatcttgccaaggcatctcaaggcactgaagatggaagcttggactttctattaccggtccaggagctgaatgagaacgagggtgtggctgaagatattgacatatcattctttaatagcttgattcaggaaatgccagtctagaatgtagaaggctattattcaacgcgagaaactcacaagagcgctctgctcttgatatgatatgtataatgtttcttagtctcgactagattgcagaagctgatttggctgaggtcttgttactcaaacgaacttctaggaaaaccacttcatggcgctctcacagacaaggtaaatcagcccttcactgaggacttatttctaccgcctccatggaggtccgttatgtatatcaaatcaaatttgaagattgatatccattcgacgaagagattcaagcagccagtcacatgcatttgtcggccgacaaagacgcaagaaatccgttagatgatgatccctctcagttgcggatagctgattgtgttgagtgtgactcggagggatcctttggacgaggtctaaagtgtgagggcgggaagggatatatgttgattgaaaatattgaatttctagcttagcaacccgggctattgtttgaccgtgtataagaggatggaagatgctatatcctggcgcgatctgagcgttgttgcgatggtatttaattgcgtctttggaacgaacgcacatgattaagggagaccttaacaaataacagtcagcatgggttgtattcatcgattaaaaaataatagaagagagccgaggcgatttaagcgaacacgagatattgcagactagcaaatcccgaatttcctgaacgggttcgctcgcgctgacaaaataatgactgactgttatgagtcttaacacaagccgccacgtttccgccgtttctgatccggtatttatcctttgcctctgcgacttgactcaatcgcggctgcatcacaacctgaacccaaccaaagctcctgagagcacctttccttcactcagagagcgcctttccttgattcacaatggctctctctcccctccagcgcaaaatcacccgccacgccctcgcggcagtcgccgtcctctgcctcgtcttcacctcggcctcgctcctcctcaccctcgaggccggcaccctccagctcgacggcgactacccaaccggtcccgcgcgcctcatcctctcccccctcgccctcgtccgcttcaagggcatcatcgccggcggtgatggcgacgacgacagctaccaggtcaccctcctctggttcctcaacgccttcggctgggagtggccctcggcgtcgtgggacctctcctgcggcatcgtccacaacatcaacggcctcctccccggcgccgccctcaccctccccctcgacctgggccaggcagcagcgaggatgcagctgccccagagcgactggcagtgcctcagcaaccgcgcagacggcaacggcatctgccacaaccccttcctcgccgcctgggacgccgagaacctcccccccgtctcgttctccaccgcgcccgccctctggctcttctacttcacgggcaccgtcctcttcgccatcctcctccaggagattggcatccgctggctccccgttatgaccagctgctactgcccaaacatcgtgagcaggaacggcctgtgcccgtgcctcaagagcgacgagaagttgaccccggacgtccgcacccgcatgcgcacgtggtatctcgtcctcttggccatcagctacaccgcagcctcgactctcctgacgctcaaaggcctcgcgcttgttcagtttttgagggggctggattccaagatcggagggatggatcctcagctggggacgacgtatatcaagatgagcgccttcactttgatcgccattctgctgtcagtgctgtgcctgagagtgaggcagtacttggagcagaacaagtcgtggatggagcagcagggtgtcgatgccactactctgaccgagcctggggccaaacccgctgatgaagaagcaacgcaagacttactgatttgagaatagcatagtttcttattttgtttccaattgaagactgtagacaaattccaattaccgtgatgtatctacttcgtgatcgttgaacaataagacaacatcaatgtataggtgatgagagatgtattgcttagtctagtctgctataggaatgagttctaacactggagacgccagagaaacaggtatactaggtcaggagccgcgtatgaggcaacatgtatggctttgtacgtaggtattgaggattcaaagtgcattgcaccagctgctcgatttgggagcattcttgctgtggccaccgtcactaccaccaacgccgacctccaaccaagcgtttctcactttatcggcggcaggcttaccgaacgcctcctctgcaacctcgatggtgacagtggcaaactgcttgaaactgcatttggggggaatcttgccgctggtcatggtcttccaccagatctgcccagctttctcccaggaatacccgtcaaacgcaaccgaggcgagataaaaggctttgttcggaatcccagaatagatgtggacaccgccattgtcctcgtacatggtcttgtactgatccatgtgatctacttgagggtctttgccctacagttggtgcatcgtcagtaccattgttgcatgtattttgtcatggcgcactggttcaagacatacaagttttgggtcatcataggcgcttccaggcgccttcatgcttcgcagagctgtgcccttgacgcctggcaggatgcagtcctcgccaatgagccagtctgcgttcttggcgttttcgttttggacctgttgtttgaccataattcctacgacatcggagatgtgctcattcagagcgcctggcatgccaaagtagtcaagagggctcgtgtgttccgtgactgcgtgggtgagttcgtgcccgatcacgtcgatgcatgaagtgaagttgtttagaaactcgccaccatcaccgaagaccatttggaccttctccggatcccagacttgagcacgatgttagtggcttggaaatgatgtgaaagcacgttggccaggaagccttgaacctacaggcgttttcgtaattttcaccgaaatgaacggtgctaatgacatccatattcttgttgtcgatggaatgccagttgaagtgctctttgtaaaagtcgaagactactcctatgttaccgaaaacttggttcactgctttgtccttgacatcgggctcgccctcagatcggataagttgcccaggaagctcgctctcgtcaaagttgtgtttggcgtcgtggaccgctcggtagtagctttctttaggatctttatccttgcctttgtcgtcgtcggaggcgggcttctgctcggttgctacagcggtggagggcgagttagcaggacgctcatcatcttcagcaatcacgaaggagttcgaacaatctagacctgcttgcgagatcctcacgcggccaagaatttgctggaggtgctcaaggtctcggcgagctcgagaacgggtcgtctcgtccgccttgtctgagtcggcgacatgtcgtagcagcgcgtcgggcacaattcgacggcgagctggggccttggaagtgtagaagtatccacgaggggtggtgagatgggtaaagagttcctttcgggcagttgtgacgcgctctctggaggcgagtgagtgcgcagcggcatggcgaatgtgatcgggattgctggcggaatcagcaatgcccctgagaaggtggggtgggacgatgtagcaacggcagcgagacatggtgaatatggatgaagtgtcctaaagatgttcgaatatggatttctgagagcgaatgactgattttgagagcgagcgactgatgtttagagatgatatgggtggataaccagaagaaggggcgagatatgaagagtcgcgagcaaaacacttcaatgttcaagcgttgtgagaaaacaaaaacaagagaatcctggaacaatcgtaatggagaggatggcatgggcactttccaaatcataaacttcctacgcaagtgccaagcatgtgcacactgttcgttatctctttccatgtggttgacactcgttgttccttcctgcctgctgatattcggctccagcaacaatacgtcattatatgctcgtatcctctgagttctttcgattgttttttttgtctccaattagttgtgttctttctaatacgcttaaattattttcgtgcagttatttttgtacagttgaaaactgcagtgcatcatccttggccacaaatgtgcctctgatgttttatatcctagactgaaaccctacttctgagaactgtaagcatacacgctcggtttgcccaaatttctggatactagtatatgagaagaaatctttttcattttatttgccctttcagtcaatttcatccatcaacaagggctaaggagcgcagccggttcgcatttcggttgacacgttgttattggttggctattagcaggtattccaccatcctaatatgaaggaataggtaccactacatccaattttttcattaaatctcaggctccattaatgcatcatcctacatggagaatgatagctagttcttcaaacttccaacaggtagggcccctattcccgcgaaggacgaaatcatggtacggcttccgccgacttcacattagtcaaaaaagactcgctgaattcggttcacttgctaaccacgtcgaaaaggtattgtttgtagtagtggaaatcaaatcttctcgactggtgaggtgggcgcaccctctgatttctatgccaaaggtgataatgacattttggtatcgaacaatcaatccgaatttcccaaaatcaagtcactctactaggccaaaacctgagtccgcaaaaggtatattttgcattgccttcagtcaatgattgatatccggtattctggctcggaatcctaaccgaagcggccacttagactatgcattccttccaaagccggatagggaaaaggaatcgtgcgagattgtttcattcatcttgctattttaaatcaccatgttcaaacggccaagatcgcaggcgtgcagggagctatatacatacgtagccgtgctctggcgagatctgatggccatagcgcctattcggataactgcgtatgagagacagccctcagacctggaacgtctgcctcagatagccagtgctccgtaaagtcgtggaatggggtcggtacccagtcccagttacgttacagaaggggcaatacccgaccgcacactctcgatgacattcagcccaattttcaagagcccattcgtaccggcaaggaatgcctcccctgctctggacagctgtcagtatgtcattcttgccatttccttgttagcttgcagacccgctccagatcaaaaagtgccagcggggctttgttcaccagggccccagtcccgcctgccatgccctgatgatcttaggtggctggcttgttattgttgccagagctggacttgctcatgtttacagacctgagggggcggcaaacatctaaaacgtacgtctgagggaagtctgttctcaatccttggcatctttgcccgcccacatgtatagagggaggcagttatcagtatgagaattgtgggagatgacgatcaattggcgaattaggtcattactttcacagtcattatcgaattcccatgacaggtggagaacaatgacacctcgtgagatattaacccttgcaactgcgtactaccgccatcattccctgtacctttagaccgcaacaggaaaacatcattccctgtcactacatggagtgttatagttatagaaaagttatagaagacagctggcaacctctctgtatctacagatttgatggccaacaacttggagtttcacttactaatcattgattatctcgatattccgattcattataacatgtctgttgagtagtcttccctgtggtttgtgtacgagagactgattcaatttaatatctgaaccgttctaccttgaccatttactgcccagctgccaaggtatagccaccatcaacagcaaccgtctgcccattcagatattgattcacagcaaagaaaagaacggtgctagccatgtcctcatccttacccgggcgaccggcaggaaccttctccttgtacttctcggtggggatgtggctcttttgatgcttatcactgccctcggtagtcatctcgctggggaacacaccaggtgcgatactgttgacgcggatcttgagcttgttcgcggcaatctcagcagccagaaggcggttcaagtggatcgccgcccccttggagacgttgtacgcgaagtgatgctgagccgacttgataagtccagaaatggaggagatgttgatgacggtcgaggaccagccttggtgcttctctgagctcttctccaggagggggaggaatgcaagtgtggtgaaatagacgccggtgacattcgtgttgtaggtgttgttccaatcctcaaaggtgctcttcttcgcatcgaacaaattctccttcatctcagcagccgactcgctctcggtttggaaatgagcgcttgagatgccagcgttgttgacaagaatacagagacagtcttcatgtttggagaagtcgtcgtacagcttacgaacaccttccttgttgccaacatcggcgggcagtgcgtggatagagcccggaatatccttgttataggtggacacgacggtgtcaagcttggatttggtccggccagtgatgtagactttggcaccgttggcagccagggcttgagtcgccatgaggccgataccagatccgccgcctatatgttgttagtcagtccaattggcatgacggacatcttcatgctcttgacgacgagtagcctacctgtgacgagagcgaccttgcccttgaggtcaaagaggttgtctcgggtgaagatcttattgtccttcttgctggtggacgacatgttgcgctgctgtattttgcttaataatattaattgattattggtacctctagatctttgacgaaatgtttgactgggaaaaaggcgaagtgcgacttgtttatgtagcgtcggtttgtgcaggaatgcattgaatgtggtgcagcgccgcgacacaaaagacatcacgatgatgaatcaatgatctaatgaatcaaggttgcggatagtgacagaaaaacggtcaagtagcagcggatgaggagccggtcggatggatggatcatagctgcaattaagggaggctttttaacctcatgtatgacagtttctgcttggtttcatcatgatgattattagactggacaaatcatcagagatttccggacaagacattcctgccatgacgagtacataataagaatcataagaacagcagcagatggtgaggtcaaagactgtcagacgggtaaatcgctagtgtctcattagcggacggcctcatcgacactgaatcggacagcggggtagatttggtgagattgggggcatttaagctgctcgttcgagtcagtgacatgggccagggtcggggctttgtcgatagagagaagctggctggatatattaagacaccaggccaccaggtcactgaggcaagggtatctatctgatgaaacgagtgtcaagactgactggctggaggatcggtcgggcaaatggcggaaagcctgctacgaggcctgtcgcgatcgttcagcttccaggatcatgcagcgacgatctctcccagccatgcttttcctttgctcccggcacctgttcttatctcagtcacgggctcggccctatgcctcccattctcatcgacgcgttcgtttgacacgtcccagcagatctaagtggtccagagtgagatcccaaagccagccagacacataacctcaagaccctccgcttggcgactctctttcccggggtcaggccttgtggtaagtcggactccgccgtggaccaattccgcaggtctctgtgacgtgaaatcccgcagacttggctgaggtgccagggtatcgtggaacccgcgcgcaagggtgctcctgaaggattcaacatttgactaatgcagctattgcaagcaagaggggagggatgatgaagcagcgctttgcttaccgacgtcggctgcagccctcggcacttggcccagctgctgtcggccaacacatatcaggcgcggggaccctgcacatggctcacgatcttgcatgctgcttcttcccatgctgttttccctcctgcacgatacctcgtgaaggtgtcgcacgggctcaggatgagtgatctggtatcggggctccagacgaacccggtcttgatggccgggttcatcgtcgtcttggtcttcttccccttgagcttcctcgtcaccggcatgcggttctgggcgaccaaattggccaagaggagtctcgccgcggaggattggttcgctctgggagcgctcatcgcctttatcctctgggtgatcttccttgcaatgagtacgtcttctttgaaccttactctcccatgggccgcctttcttacaatgcaacagtggccatgaacgtgaaaccagaccctacatacgaagatgatgctgcatctaacagggtaagttgccgctcgggtcaggcattaccgtaatcacatctaacctgcgcatgtagatgctctgggcctcgaccctcacgttccccatcaatcaactctgctccaaactgagcattctcctcctctaccagcgtatcttcggcatcaacccgacatactctctgtggatcaagatcatcgctgtcattcaaatcctgcatacgatcgagaacctcttcgtcgacatcttcacctgcgtccccgtccaaaagttctggcgacccgatctcgaaggccgatgcatagaatacgttccgtttctagtcgtcaacgaatctgtcaactctctcatcgatttcgtcatggcaatccaggccgtcatcatgctgcgcagccttaaaacagctcgcagaaccaagtggcaattgtctgttatttttgcgattggaggcttgtaagttaccgcccttgagtcaccgtcggatcctacctggagtcgcatctaagctgatatctttaaccagggcgggtgtgattgggttcgtcaagatcggcgtgtctgtcgcgaatggtgtcgccgtcggtacgtgcaatgtttatcattgactacactacaaagatacacagatctaacgaaactacctagaaaaccaatatctcatgggcgtgtgggcaacagtccagatggcactgagcatcttctgctgctgcgtcgtcaccttcaggccaatcacgctcaaattcggccagatgacccggaagctcacctccaaagcaacatccaccaatctcaccagcaagaagagcatgggaacaggtcaattatcgacaagcgcaacgcggaccaatcagtcagacgcatggatcaacttggagagcggccgagggggagctacgcatcatcctccctactacaaccgcgaggacaattcggacgacttcccccaccacattaagaattatcaatttgggtggcctaaaccagaaaatggtagatgatggagaaaatggcgcagcgcataaacagggtgtttgctttggcgttactcttcttgtttgatatgatacccatgatgcgaatagagatgcaaatagaaacacaaattcggcatatattctaaatacaaatgtcaaaatctccaatatgatctctgaaatgcctctgtcaatcgatttgacccatcctacacaagatactacaaagaatagtgaatcaatgataaaatttagaaagctatatcataaataaaagtccaaccatctgaaagatattgccaggcacatcaaaataactgacactaaaatgctataaatgatttaaacataaaacattatatagcattgcttgtttgtcgcgacatcctcaaagtaggccgcgcacaaagcagtgtccattgtcgtcgtttgtctgcgctcttcaccttgttctcacttcattgtccgcgcttgttgtatttagaaaagctatttcgtcctttctaacaatgaccattcagagtgcaaagcaatcctctctgaatgaatcccacaatgggatcatgtacaaatacgtgccatgtcatcccaatttagatcatgtacttctcaaaacattgaccttgatgcttttgcaaactcgctacccgatgatattcaatcttttcagcaagttaacagcatttctatcaaacggcgaggttgaccctctcaatatcactgagaatatgaactccctgccatcgtctctcgattccacacccatggcgtcccatcagcaagtcccgggccaggagcaggcctccccggccgcacatccagagggggacaatgcacaagcaacagctctaccggagccacgtgtatcaatcaaggggaccgttcaactccagggaaggcatcggaaccatctcttccctggagaaatcgtgcgacctggaaggagtggagccccagatgatgtgctctttgttgctcgaaagcgacccttagaccatgagaatgagacaatgacgcgactaaagacgggtgagcagatagaggaatttgaggaacctctctgtgaaagccctctctctgaagaatccagagaacggttagagcagacatacggacggctcgaaaagttacagacacaatacatgtctcccgacgagctgcagaacagcgaatggcacgacgacgaagcatggttggagcatatcaaggttatgcataacctgctgtccaagatggtccggaactctgccaatagggatgcatggttagaaagcatcgaacttgaccacttgttgaagatagccacatatggaatggaacaggacgtagcagttctggaaccctttacaaatttttacgacctcgagaagggtttgatgaaaaacaagttctacgagtttgatgatgcatgttacaatctctacaattcaatgccgccattctaccagttcggggacgacgagcctctagtcatcttggaaatcgaaaaagtaaaggcagagatcaagggcaagaggtggctggttgcgccggtcaactggcagacggaaactttcgcttaccactggagcatgaccatctttgaccggctgacggggcagttatacatctttgattccttggagaataaatacaatgacacggcccgggtcaacgcgacagcaactggctgggcccggttctgggacaaactgggactcccctacgacttccagttcttcgcccccgttgtgaccccccagtgtcaatcctgggagtgcggctatctgagtgcggtctgggctcttctcacgctccgaattccctctaatcccatagaaaacacacctggccgaccattgagtattaatttaagcccgagggactggcaccagcacattaattcatcgccatcaatgctcatcgccgactggacgggctgggaaccgaacacccagaacgcccaggacgcgctggaggaggctttcaatttcctattcgcaattatttgcaacgagctgggcattccggagcgctatgtccaggccgacggcatcacggtgctgctttcttgccaacacacggaccggtcatgggtccctcgcgatgaacatcagtcatgcgatgccagagttcatcaagagggggtcgaattgcttgtgaatacctataaagtcaaggatcggaagatcaacacggttccaaattcgagccaacgcatcttgcttggcccagaagtacagcgtttgatttgttcagctcgccaaccatgcagagaggctgagggtcaaactacagccgcttcaagtctagatacgcagcagctttacgagcaggatcttagtagcggcgacaagaacgccaatgatgacgagcacaaagatggcgagaatcccacagccggccgagtctcaaaaaccaagaccaaacccaaggctcagcccaaaagtcgggccaaaaccaccaccagcaagaaagcggaagtgcctccagccccagcagccttaaggacaagatccggccgcaagatcaaagcaccagatcgattcgaattcgaacccgaacctgaacccgagccagccgcgcccaagcccaagcccaaggcggcaccaaaggcatcggaggcaaagcctgcaaagaagaagaacgcagcagcaaagccggaaccaagccgaggtggcgcgaagcgcgctgccacgaaggagacgaagcccgccgctgccaagtccaagaagcgcactctggacgagactgaaccaaaagatggtaaaaatgctccctcggagatgcccaagtcgaagaagaggaaagttgctgagcctcccgccgccagcaagccggccaagaagcaaaagaaggacgcacgcgccaagcgctaaaccagcttcgcatatatgcctttcataggctcaaacggggaggtgtatcgatctaaaagttttttttaaatatatggtggtcgtggtgatggccatcgtggtagactgcgagtggcgcttcagcaggctacaagctgtgtgtgctgtacacttatgaatttttattctccatgttttctgtttgtttttacatcaaattatatttttccttgttcatttatatttcagctacattatatttccacgttattatacagattgtcaagttattagagcacgatgtcattggtgccttcgctataggtttgagactttggcgtcgcgaatgcccaactccttcccatctacccaagctatttctttttttaatttttcaagctgaaattctccaactttctctagctctttattttatatgtgattgacatcatggtcaattggctcagtggcgaccctcaatcctgtggtctaaataatgtgatgccctggctatgtgctcgaggacgatggcctatccagtctgcaacaggcggtggccgtatggagcataacttgttccccaagaatgaagattcaacatgatcatttgcttcattgtccgcaatacgctgctgtggcagacgaactctaccctctggcacctggtacactgactcacgttgccctccagtctccagctagagcaatcccgaatgcggcacctcggatttctgttctctttgaagtggtatcttatgtccctctcaagttaatatgcttaactccaacgctcctgctgctcaagagccacggtattatagctacctatctaagtcaaagcatcaacataggcccccccaacaagaagtttctactcttcatgatgacacccccacattagtcgaacttatgtggtcaaagcccggtttcctagagtgtaacttcgctacacgtcttccttctcccatttcgcgttcccgaccagtcggcagcctcatccactcacccttacccaaccagtctctaagttggttggttaatgcctggctgcgtgaacgggatataaaggttatgtggaagatgctaaatggctcccatgccagggagcggtgaaacacccacggggcttctgcagggatcccagtatttgaacgcggcccctcagccacctctgccagtgtgctcacccagacgaccatggttcttgagcggccgggctgacaacatcaccatgtctgcgggcctctctacattgcctgaaatccgtccctcgccatgatcatctccgagatcgcgaggggatgacgtagctgagccgccgacttcacaaccagggagtcgcatcccggctctcgcgcgcaaccacctcgcgagcggtagatgtcgactcggtgctttgcgaagcttgcatcctattaagggccggaaggcaggcaatggcgcaacgcgagggtggatttacaatatgtggcatctccacggggagccatgtcaaccacggccctcaatccccatctgtggggggcggcggtcaatggcgtttgtagcggtcaaaccgtgtggaaagatgccagttaactgacaaggagcttcaggagtgatctccgaagaactccaatggggccgggtcacatggcgcgtctctcgcttacagcgacgagtatctgtcggcgaagcgagggcgtcattcagagaagcgtaatatgcaggatataggggactttttccctcgtctcagcaccacacatgagatactgaaagccaatacgacaatgacggagcgaggcctccatcaagggaccttgcgatatggtatagttatgtaaggatacagaacactcatagagaacactcacgcaacccacgagggaagaaacaggtcgaggagtgcggtacgacatcaacgaatcacacagtggcctttttctgagcccgaagagacgccgtgggccatcatccccgtagcagcgaaacttcgagagatccctagatcttctagaatgattgtcgacctgaaagagggaccaaaagtcgttggctcagggttgcctggctacaagccatccagccgccaccccctggccaagacaaggccgagagcttacagccacccccggacaagaaaaaaaaaacaggctccccagcaaggagagaatctcggaatgagactagaatgttgagtgccatgtaagaacgtcgttgaaggattgaggcatagaattcccgattgacccggaacgtgggccttgaatctgttggtaacattcgacttcatcgtcatcaagacagatgagttactatgtggccatcttacacaacagagtcaccagaatggcagggattctctcgggatgtgttatgcaggcatgagccaggaccaacggggtcctacatctgttgaacgcgaacaggccaagagacaacgagaattatccatgggaccccaggcaaacccccacgccgatacgaaggcatctcgcatcaaaccgttgggcggatggttgagaaaagaggatggtcgagagagaagccacggtgatcgccgcatgggaagagcggggggacaatcacataaccacaggcatcaccgagggcttcattttacgttttcaatctcacctgtccttctcttcagccattctgcatgattcgaccatcttccaggctccctaggtacacaataccgtagcacgttcgcgtcatcgatatgctggtagatgaatcatgccggtctacatcattcacagccataatgatagcttaatttcagcttggatgtgtgtagctttgattcccaccagcctacctgcccatgggtagatcaatgattcccttgtcaccaatgggcgtagcttttttacactttccacaacaacaaggttggacacactcctcccgtgcaccttcactacttagacctcgggcggaactgtgcgagcaaagtttgagggtgtcctacccagagaacctactggatggggaattctgtggcgtgggcacgttctcgcccgggcgggctgcatttgagagtaagtagactgcatgctctgtaccacacgatcgggctgtctgcagcacaagatgggcaattatacccctcaacaggatcggatcgatcgaagatgacgagaggtggcttgctcaatgtgtcaggctaagcccaactacactgtccgcacatttggatggtaaggcgcggggtgcaagcctcgctctccagcggccactcggcgtgggccaaaaataaagggtaatggtgatgtcggcaggtcacaagatggctaggtgttggtcaggtgcaaccgagagagatgcctagagtcaactaactcatggtcacgttcaccgggatacaaccacaactgtgtttttgccttgcttatggatcaggaaggtgcaggaaatacaaggcaaagaccgaagcgtgttgcggagagccaaaagagacaagtaggagggagccggcatgtgttagggaaggttatatcaaacgagaagagcttcatacatggacaaaatatgtgcatgtctaaagctcggttttcccagtcaagtatgggcggcgcagatcgaggtgaagccgctgttaacctccccctgaaagaaaaacgatgctggcaaagtgattcgtttactagggagatatccgaacggggagtttaatcatcgaagcatcctgcttgggcatccattggtagcgtccccggtcaagttgctgagatcagatgcctaactgtgcttatgcgtccgctgaggacgggggggcgcgagccacacaaatttctgcagagaaccggttggtcttggccagccactcgtccagcagcctggaatcctgaccagcagggataggtgcagcacagacatcatgtatccgtactcgctaccttgagccccattttagacagccccgtcgattcgtagaagacgagtgatagatcaaagattgttgcaggaccctcgtgatggaagcagcctatcgaggttggatccctgtcgcggccacgagtattgcacgccacacaccaacactggaagccgattggcccaggcttaacccacaaaagcctcgcggggttggttgcgatggtctgttcctgtccgtggcctccctacaattgttgcttcatcaggtgttgaagcccagactaggggagaggagggcggcggggagctctgaatgggcggcgggaggagggtccgatcgtaggggcattcattgccttgcagctgagaaacgatcacctggtcatgaaggaggggggcgaaaggcaacgggttgttcgccgcgagatgagggggacattcgggtgtagaccctaccgcttggtggatgatctgcccacctgctttgagagcaagggaacatgaacatgtgggaaggaggggaagtggaagtgaggtaggtactggatgttctctgtgatctgcagctttgaatgtacagctaccttcttcacagggactggactggctccaacacgtgacccccctgacagacttgaccgtcatccatttgccgatcctgtggttgatccaacagcgggcaggccccccaaggcaaattgctctggtttgatggggtgctgatttagctgcaaaccggacgttccgggccgctggtgtacctggtatcgacacgatattaataggctagtagaatgattgcctacccacaggctacaggcgactagtataaactattcacatgttttcctttcgatccctatggtcatgtagaaacagcgtcgtacctgcgatcagtgacccggaaatgtgcgctcctgatatacctggtcgacctcgcattctcgtggtctcggggataacgagttgcgaggtagggggagacggcggcggtaatgaagaagtgagatgttccagtgggtgccgatattattagcaactctggctggatatcgtggagcaaaagaatgcggactgtaattgtgataattagcgttcccctattttttcttctcggcgaagaaaatgagagttggagcttgaccaacccaggaggacggtcatctacaggcggcgagactgtggctgtgtcgacggtgagaaattcgaggtggatcgagtgtacgtatcaccaagggcttggtacgtgccagtaaaatcaagcgaagtgtccatcagagcaacgattgtgcatccacatagagcgattaacatcgatgcatggcatggtctggtggcacttgtggagcattcgagccaatttgacaggtagagaggttaggctcagggacacatgaggtccttattcgatatcatacgcagtcgatgtcttgtcctttcttgccttggaactctacgcgaggcagcatgccgtctcattcgcccctcgtcgacgaatgaagcgaggccggctggaatgatggcagccagaggagaggacagagacaaggttgcccagatccatctgccatgggcgaggatgtctatcttcattattgttgtttgatttgctgttgctgttgggtgttactggtgttgctgccgatgctgacttggtctgtgatcgaatagataggccgacagcacgtataataatgcaagtaagaccctgactgccgcgatgtcccctgtctcaccgcaagcacaggaccaggtcgcctcattatctggggctcatcatctcggtgttgttccaggcaacacgactcgtctcttattaattggtgcgtgcttggtttcgagatgcatgaggctgcaaacggatggccaacaccagagatgacttgctgcttggttgggcgtgttgcacgaccaggagttgattgagctgtcgtcacccagccactgtcgatggatgaccgagaccgaagggcattctctgtaacaaccagaggttaatttcacgctctgacctaccttagctacagcttccccatgtgagacccatcttcattacagcgcggaagccatgggcgcgcctcaggtgtggcgcgagacgtccagaagcgacggggaacggctggggctgcttcttgaggaacgatccaagcaaagcgggaacagctgatgcgacctgtcatgcggccatgttaccaaattgtgaaggataggccacggctgcacgtgagatgagacgggttggtggcattgcgcatccagtgccttgcatttccggctggctggctggctggcgatggacgaacaccaccctcacaccgggctgaggcaagcctaatcaaacggtgcgtgtggcatccatccagcaggcagcataattagcatcaggttgggatgcaaaacaagcgggaaacgtcttgcagacaaggacaccccaccacaggcggtcggcgacaggggccagctggtgggaatctgcacatcctttctttgctttttctgtcccgcccgcttcgtcgcctcctcatcgatcgttggtcagaagcgcattgtggtgtgccaattgcagcgcaaggaaaccggctgctatcccctccagatggctgccatgcagagaaggcggcgcagctgcagatgaggcgtctcggaagttagagagaagcaggaggaagggcaggcccagaaaaagaaaagaaagaaggttcactgccccaccaatcgctcctgggctaagatgcctgctcagcgccgggttgccaggatcgctgcccgcccaccacaggctgcatcaggcctgcagggggcgaggcgtcgctggtacgccagttgagcacgactgagtaatgccggcgagggccaacaggaacagcagcagcgagagcgagacatgagttggccagcagggctgcaagtcggagtggattggctggtcggtctggcctcgcaattctgcagctgggaatgtaaggtgtaggtgagggtacgtgccatctctccctgccgttgcgcatgttccagatggcggttcatgtctcaatgctgctaccttcctgtacctgcacccgctgtaagctggaacaagacctctaacaccagccctccagcgcctctgcccagtccggcagttcagttcagtcagcgcgacgcaatccaggaggcaccaaagtaatgaggtacatgtacctgcgtaatctcagactggttgtggccataatttcctgcctcaggtccgcccaccacccactccgacaaagaccgctctactttgccgatacatgccaagtgcggtgtagattgccgccacggcaagtacttgctcgtacccggcggtgtcggcccccatcgcaaacgacgggtgggcaggtacgttcccggggggcaggtactcccctaccatcatctgcccgccgaccgcctagaggaccttccaccattagcccttcgcagtgcatggatggaaggccacaagaattttgcacgggacgctgttctgcgcctgtccagcccgctgtaattgggccgccggccacctggagactcccgccaacgcccctgagtcggtcagtaaaggacatgcgctgcaaggtaaaggtgatgaagaacctccactaacagcagagcagggcaccggccggactttcgtggagccgctggtccttggtggtcgctgtgccatccccttttccctccactcaatcttgcactcccgccagcccacacaccccccttccagaccctattttcttgttcccatgataccttgaccttcttgcttctttcgcccgtctccccccctctcttccatctctgcctcaatccccgttcctcaccacgcggcggaaacgtttgacgacttagaaacgacggtcacgacaacgacgcacgataattagactttctaccccgtcatttgcgatcgctcttttcctccgcgcctgcagcgagtcatagcgttgcagtcagcttgtcaggctccttcaaccacaacaacctgccccagcgccacccgagacgacgcgaacctcgaccctgctcgctgccaccgagatactacatcttcggacgtcggtcaaatcatcttgctcgcatttgcgctcctttccagctactttctggcgacttgacgagacgtcactgttggtggagctcttggccgtcactggaaaccccccagctcgggagaaaaaaatttgttcgaccagaccgaccgcttgagctttgcgtcggtacgcatttgctcaactgcgcactctctgccgaggcgacccagtgaagaacgtcttgaccgatcattcggactctgggctgactgccttttattttattaactcccaaactcagcgttggcgacgtcttgattgactgctgccgcctcctgaaaactcggtatagtccctgcgactacttcctgatgcactgagtcgacctcccctcttctctctcaacctccccctctcgatcgcctccccgatcagaatactgcatatcggcgtcgaagcttggccattcgcttcctcttttcccaaaacctcctcacccagaacgtgggtttcccgcgaccatcattatttccacatcaccgaaccacatccagccatggcccaaccaccgcaagatcttagctaccttgactatggcgcgccaccaaaccgatcccctggctccaggcctagctacacgggcgctttcggaggcggtctctcgctccctcgacagactcaacgacccttcgatccccctatggggtccaccggtctttacccatccgacaggcacggcggctaccacccgcgaggcatggacaacatgaacaatggcggcgggatgcccagctacttgctcgacaacaaccaccagcactggtctcagggaggcagtggtgttgcaaccgtgaatggggccgtcaatggacccagcaggcaaagaagtgtcggccgccgtgcggccctcccccaggtaggaaatacccgctgtggacttgaccgccagaacgtaggtgtgaggctaacagatttgacagaactggacagatcacggaggcatggggttgtcctccaacatgcagggcttcccaagtggcctcaatggcctcggcaacggaggccttcgcgtcgaacatcccggcacccacgcttctccttccgacctccgctcgaccgcttcagacggtgaccaattgatcccgaccgccatcgttatcaagaacattccgttcgcggttcgaaaggaaacgctggcttccatcatgctggaactccaccttccccagccgtatgccttcaactaccatttcgacaatggcgttttccgaggtcttgcatttgccaacttccagtctgccgaggacactagaattgtcattgaggccatgaacggcatggacgtccacggcaggaagctgcgcgtcgagtacaaaaagatgctaccagaggctgagcgagagcgcatcgagcgtgagaagcgtgagaggcgcgggcagttggaggagcaacaccgagcaccgctcctccatcagcaaagctccatccagtcgcttggaagcatggcgcaggcccaggcaaggggcactccgagccattcaggtaagtctatccaaccccaaattaattataatgatgtgcaaacctgtgctaacatgtgcaacccaccagtcgatgcaggcgacattgacctcaacgaccctcagaccctcgaattctacactgagctagccatgttcaagagggacgagtcgcgcgagatcctcatcttccctgccggaatcgcacccgagcatcgacgttcgattcacatcctcgcgcatcacatggggttggaacatcaatccattggtgaagctgattcccgtcagcttacggtgctgaagcgacagccttcccccaaggccaacaacgcccctgccccttcctcttccctggacatgcacaagaggggactgagccgagctgccacgtttgactttgctgctgatcgcgagtcacggggaggcaacagcaacctcactcacgtcatgggacgacagggccctacccttgagcttcctgggagccccgacggcaacgcgattcccaacaacctgcgcgctgccaagagtttcgccgaccttcgctccttcactcccagcccttcgcaggcttcctccagctaccttgcccctggcggcggaatgggtggacaatccgcagcacgatatggcgattatattagcagccatcccggcagctccgggacacctggccccaaggacaatggcctcatcagtggtctaagcaacttgtcgcttggtgcttttgaccccaacaccctgcaaacccagtcgcgcagcacccctggagctattggcagccagcgtcccggcgccaacggtaactccaagggcgcacccgagaggcagcctcggggccctgagtgggaaacatccaccggttttggtggacgcggtcgatctaacggtcatgtgcctcgcggtagtggtacgtattacaaactttaaacccaccatggtgttgatctggaccatgtgctaactcatcgtgggcgtagattcttcagacaacggagctcgtgttgcaacgagttcgtccggcgtctcgaggtttcactaaggttgagggctcaagtacgcccggcatcactgactcttctctcgacatggccgccgagtcagcagccgggctcacgagaaacgccttatgtccttgatgattattgcatctgtacactgacttctcctcagggccattttttttgctgccctggggcatgacaatgattgctgaatatgggcgtcagtccatccttggcgcctttgtattgttttgatgatgatgatgccacctggatgaagccgacggaattaaggatctggataaagggactcttcggcacatgggcaaccatgcatggaagtccatgacactgccaaactggcggacaactactactactactgattgatatacccgcatcttgggagatgtttattttacacttgggaaggattctacaaccatttgacgataatgacgacgctttcacgactttacgtctagacagcagcggcggcactggcttttgtgtctcttctctgatactgattgccaacgcaggtcagccagttgcgagtggttgtttcggcgacgaaaacgagacgactccacgtacttttaatattttccgactgccgtcgcagatacgactatgacgacgagttgcaagaggtcttcctgtttattttttcatgtttcatacactttgcaagttgttggtcgtattttttgaaagggtgtacgtgcgcgtgccgttttttcttggatcgacgaacatgatatgggagatgatgtgatcagactgaggacgatgaagacggaggaagagaggaagatgagagaattgacaaaaaagaaagaagaaagagtgtgcattttctgtttgtttcgctggttatttttcctttcttggttcagagtgtctgcggaggaggggtggctgttttgcttttttggacccgacttcctttatattcttcacttttcccctccattttgcatcttgtttttggcctcggaagatcggatgacctccaatccttcccgcatgggctttactcgtcttccgaatacactggagaggggggaacaaaaatggggcgacgattttggtctgggcccagctggaacctgggagggaggtgggcgggtgtggcgtttgaacggatagcatattctcctatgttggattggtacatggtcccgcccgagttcgatgttgttctactgtttgttgttgggctgctggtcgtgtcttggtcagacgcggtggcgtggcagttgtgagagctctggccgatgaggggagacgatggtgttggattggcaatgtggggagagttcacagtagcgatatctgaacgcgtatgtgtgtgggagcgtcatatacttagcatggcatagtaattaatcacgttgttttcctgttggctgttacaagatggacatatttgagtgcgtactttacttggccctttgcctgtgcatgtataacagccgagagtgctgcgaaattggccaacgatcttgatcgatgattgttggccttgttcttggtcatcaactgccttgttcataacggtcgtccgtcaatgttaacttgactgcttctcgtgttattgaacttggtgcctacttctcgtgttattgaacttggccacctatcaccactaccaacctcgcctatcatacggagtcttgtagccgtccattgtgacaataactttataagtctagaccaagatgtctgtcgtcaagacaagttgagccggcttgatttgtcatcgacatgatggtttatttgtaagaaatctaggagtcggctattgcgagtgtcaataggaagccgacaaccaagtcatctacagtgacagtcaattgaagagaagccgatctggctgtcggctattgaagcagatctgccctgtcacattacgagtcaggtcagtttgatgctggttaaatggctggcactgtctccgtctccagagtatatgcttatctgcagagtcagttcgttggaaaacctcctcccatcacccaaggagacttcatcccatattcgtagccatgaacattccagccgccgaccaaccttttcgcccctgaaactagccgtgtgccatcatcaccaggctccatcaaaacggttgagatgtttccatgacgggcattaataataatgacagcccaaccccacttaacgtttgggctgcatcatcatcgctgatcgctccatctcggtgtcttccgtttcatctaactcttatcagattctaccccaactttatttgactccatctcattgtagaactacatataaaaacaatcctcgacacttgagtccaccaccgtctatccgtgacaagaagccagattgacaccaatttcatcacacggagacgcagtgaagcccaatagacggccatcccattcgctcacccatcatcatcaccaccatgacagccaagaacaggcagtggacaaccaagcaagatgggctcgataacctcgagctcggcgagacagccatccccgagcccaaagacggcgaggtcctcgtcaaaatcaaagccgtgagcctcaactaccgtgacacagaaggtaaaccctccccctccatccatcccccgccaccctcctccatctagacccagaccaccaactgaccgtccaacagtctgccagggagaatacacccaccacagctccctcgacaacggccagcccctcgtcccctgctcagacatggccggcgagatcgtcgcctccaagtccccccgctggcagaagacgggcgcccgcgtcctctccatcttcaaccagacccacctcaccggccagatcaaggagtccgacctcacatcgggactcggctcccccctcccgggagtcctcgcccagtaccgcgtcttcccggactacgccctcgtcctaatccccgagtacctgtccgatgaggaggcctgcaccctccccatcgccgccgtcaccgcctggaccagcatcaacggcttccgccctctcggccagtacctcgacgtcaccacccagaccaaggacgagaagaagccaccgcccgtcctcctcgcccagggcacgggcggcgtctccgtcgccgccctccagatcgcccacgccgccggcctcgccaccatcgtcacctcctcctcggacgacaagctcgaccgcgcccgcaaggaactgagcgccgacacgggcatcaactaccgcacccactgggagtggcacgagttcgtcctcgaggccaccgcgggacggggggtcgactacatcctcgagacgggcggcgccgacaccctccgccgcagcttcgcctgcgtcgcctttggcggcaccatcgcctgcatcggctacctatcgggtaaggacgacgacgagggcgacggcggcctgaaccggctcaacgtcaacgtgctcgcgctgaggcgcaacgtcacccttaagggtatcctcaacgggcccagggacaggtttgaggagatgctggggttctacgagaagaaggggatccggcccgtggtagacaaggtgttcaagtttgaggaggccaaggaggcgttcaagtatctcgccgagggggcgcactttggcaaggtggtgatcaaggtggcagactagagagccaaattcaacttggacagcgaaaagcatgaagacactacaaaccaattagtcgcactaatcaatgtgctgtatctattgaaggctcgcaaagacaaagaccacagtttctatgatcagtaaaacccaaagcataatgtaattatcatttagccaagctcattcagcttcaacttgacagttcgagatgtatagggtaagtatcatttggagatggaagatttggctgcaataaaaagcaggtagaatagacacgcaagcaagtaatggttacgaataaattgatccggaatcggttcttttgatacagatctcctataattcgagacaaatatctttacattaaaatcaaaatggcaaacaaaccagcaagcccatcgcccaatccatccgagagtcgccatgattgaaaagcccagtttctgagaccaaatcaaccgtcctcccattaatgcttggaacaaatccacgtttccatgttgtcccataacaaagcgcctccctcagatgaattgctcaacccagaaacacgtcactcctgccaaataacttaggtatcaaatgctagaatagcaaaacccccacaagggtccttgcgtttaagctttgctgttgtttgtttgcgagatgtacatcgttcaatcgtcagttgttgcgggctataattaaagtaaaatgagaaagaaaacccccttcatacacgacatgattgggcctcggaacacgcgcgcaactcctcaaaaggcgaggaaacattttaagagtaagaggcaccgagataaatcagggtgttccaccaaagtcgaaaatgccatgaaaaaaaacccacgaggccctccgggacgccaagcttgaaacaggatctggaaatgcaagcatcgtctaagcaacttcggcccctttaacaaaaactgcactagtcatagtgcctgataccgctaaaggattgcgcaatgtgttcagatgtgcggacaatccactcaagcttcgatcgttcaaggttcgccaggaaaggatcagtggggtagccatcctggatgccgtcaatgaaaggtcgcactttgttgaccaagagctggagtgtctgcagggcgctctgaatgacttcacggaaaccttgttgctcccactcctgttcagacaatgttagcaaggagataattgagagatgattcatgaatgcgagggcatcacttacatagctaggaatattttcaccaaaggttcgaacggccatttcgatccattcaatctcctccttgagacgcgggttgggcttcagatccttggaaatcgttgcaatcacgacgagaagcatcaaaggaggcaggctgtcaaacctgcttggagagtagcgacaaaggcagcgctggaagatctcggtttcgcgaccgctctggatccattggatcatggcttcctggaggcggccttcctggatagcctgttcgatgatgcggattcgttgttgaagttcgtgatcaacctcggcctcgctcttgttcctctggttggcaaaagctcctgcaagggtgctgacagcaggcacggggacctgctcagatggagcaaccgagccttgagggcttgagatgagctgcgagttggggccgccgcctcgcacgtaatgagggctacccatgtggttgttgtggtagggttggccgtggctggcagcctgactggcaggatagcctgttgaggatggcttgttggagatgctgtgaccgccgtagctctggtgccccattgacggagcaccgcccacatggctttgaggaccgggcacgcctgggagctcatgaacaggaggctgctgtctaagcttcaggaactcagcttgaagagactgttgggtcgaagcaacagttgacacaacatccgtcagctgtctaacctgggtcatgagctggtcaatcttggccgagtccgcaacccgctgagcctgcatggcctcaaactgctctgcgtactgctggtggatttcgccaaccacgtgctgagttgattggttggcaatggtagagaaggtggacgagaggcgcgacgtgagagtgcccaccacttccttctgaatggtagagctcatggaagcgctgacacggtcggaaatgctgttgatgaactcgccggatcgaagggaccggttcaatgcatgagggagagcgttctgaatttccttctgaacagagttcgccacgttgggctgtagcttgttgttgagtagctcgctaacagctcgcccggccttatcacctatcgcaggaatgaccagctcggtgaacttctggtgaacaagggcctccaacaccttctgagtgttttcgtttagaacctcagacaccatgtccaaaagtttaacttggtggttattgaattcctcgtcgcgtgtacggataccctcgtcgatcttgacatgaaggttcttgagagaggacctcaggttttcgttgaggttggtgctcaagcggcgctctagaccggcgacagcggtgtcaaacgcctcggatgtcacaccgttcggcataggaataagccccttgggtgcctccttttggccgtgaggaccacttgctccattcgtcgttgcctcgagctgattggcattgcccttcttcttacgtggcttgcgctcaggtttatcggcctggttctctttctccttggagggcacgggggtttcggcttcctttggttcgttcttgtttttgactggcgtgaccgcttcggagccgcgagcgactgggtcattctgaggctgggcggcgtgactgttgctggtggcaggttgaggggtctccttggtggttcctcgggtaccattgcgggcgtgggaggaactgtctggcgaggtctcgatcggctgaggtgactttagcttcgacaccgaaacgatgccctcatccactgcttcgacggggtagaggaccttgttgtcctttgaccaaccgagctcctgctgcttgatgaggaggcaggcaacacccttggagtgcatggcgtacagctcgaagagggttggttcgtccgtgtcttggaccatggcggggttagcgaggatatcaagacttcgaaggttgccccggttctcaaaagagtattcgcgaacgccgctaattacagcggtactatccggctgtggaatagacgagtcctgtgcgacaaggcgctgaatgtactctgcctgggtaacgctcttaaggttatacttgggagctgacaagtgggcaaagtagatcgagttgcgcgtaggatgaccaatcacgatcatacccgaggcaggatggtacatgacgctgcagacggcatccgactccttgctgtgagggaggttgaactcttggacaggcttgcccagagcaagatcccagagctggagggtatggttctgcttcattccaacaatcatgtatcggagagcacacctcttctggtaggggcgctgcttgtcgagaagaagaacagatgtcggccaggctttctctccttccggggtactggcaagggtcatcaaaggttccttaacctcaagagaggtgtgctcgggaacagggttgcgaggatcgcagccctccttggtggccgtcaggtctcggacatcccagaacttgacccgaccggacttatcaagggagacgacgacggtgtcgtcctgactgaaggtaaagtccttgccagccttgccagtgttgatcttgagagagcaattttgggacagggtgtccgtgtcaacaactcgatcatggccaggcttgaggaggttgttctggagaatgtaggatggccatatgaagttgatagacttgccgcgtccaaccgcaaagaactccgggtggatggttgaagcgcgcgcgcgtgtcttgagtacaccgccgggagtatcaccttccgacgagttcatcggggggagagcaaagccatactgctcgagatgggcatcctcgatatggtccttctcgccatcccgaatctggacccagtagacagtgccgctgatgccagtaccaatgatggcctctttgtgggtgccattgtggtcagacggagtgacggacatggccacattgaagatacggtccttggtatctgtgaaaaccttggcgtccttgccgtcatcctggcgaataacgcgaagtcctccctgcttggacataccgtaggtcatgtagttggccgaggcagtatacagatttcggtcgatctggtcaaattccttcttgagccgagcgatgtccatcgtagcctcgtcacggaactcgggtctgggatcggttgtgccctcattgagggttatggagatccagggcttcatggggaagttgaagaccttgacaggtgtgggttccttctcctcaatgacaacaatttcatcttggtcggcactctcccagctgtctgcaacattctcagctgcggcctcatgaatgacgccacgaactgcgtcgacctcttcagcaggtaggatttcctcaaggacaccttcattgtcgctgcgatcaagctccttttccagagcttcagcaacaacttgggcccgctggtggaattcctggtctgagtcagcatcgagcatcttgtcgagttcgctggcgatatcctcgtgtgcctgctcctgctcttcatctgttcggtccagactctcataggagcttctgtcgcccttgtgtactttatcgtgaatcggctcggagacaagttccttgtggtgctcaggagcgacatagcgctcgaaatcggtcgagttgggggtaggcttggacgcagagtgatgcgacgccatggactgggcccggactgacttgcgtctggttaggtcattggggctcgtcactccactgtgcaggctgccgcggtgggagccatgctgggacccgtgatgagaccctccatggtactgagatccagcgtggtgggagccggcatgctgggaacctggtgacgcatgctccttaaggatgtggaacgcaggaccagcattagccgactgagcagcattgctctgcggggatgcgttgctcaagctacccatgagatgttggtagagagcagaagcttcggcgggatcctgctgggaggaagaatagtgcaccggctcgccagactgcgactggtgatgaccaccactctcgccgtacatcttggactgttggtattgctttgccgcagcataaggatcctgcgactgcttatactgagcaagaatctgactctggtcgatctcggacgaggactggggcgtgtgattgttggagcgagacgattcggtgagcagcggctgctgctcgttctggagtggtttcggtcggttcaacaaattgagcaggaaggatctcgtatcagcagagggcgactcgttactaaaagcgctgggtggctgcgggtgagccagctgctgaggaggaggaggtgcaggggacgactggtccttggtggactcattatcgccgtcttgggcaccacgcattagcgcggcaagcagaccggttgggtctgcggcagcgggcgcaggctggtgaatccgcgtggggaactgaggctgctgttgctgcaaaccaatcgaatggtggttgccgtggtacgagctatcagcgtgatggtgagcaaggctctggtgatggttctgctgatgttcaggctgcggcggtgagtgcaactgctggggaggaggcgattgctgctcgtcaactatcgattgatgatgttgctgctgctgcggcggctgtgactgtctctgttgggcgacggtgtttccagagccgccaaacttgagaaggctcaacagattcgaggtgcggtcttggttagaacccatgttgccgttgttcactggcggcgtaggggccgcaggcaaatggtccatgacaagagccgctcaggaaggggagggtgcgagaatagcgacttctctacgatcagagacagactcgcgattcgggttgatgcggtttaatgcgatgggaggagaaaaagaaagggtgcagggtgttgacccgggaggagaagttacagaatgggagggcaggaaggatgggagaggttggaacacccatgtaaaaaaaaacaccaaaagcgtggcagcccaaccgcagaggagagcgaaaagtgggaccgcttcgggtgcgtggtgcagcagcaacagcagcagtagcgcagtgggagtggtagcggcagtgctgagtgagcggccagcaggcatcaattcgcggtcatcacacaatacagcgatcatcgacgtgggatgcggtttgcaggtggtgggtgaggtggcacctctacagccactggaagtttgttcttgtggggccgctccagcgcatctcagcggctggaccactggcccactgcgactctgctgtttcaacgacccgctttggctctggggatccgtatccattcatcgcagccaaaaccaaccatccggtccgccctgcaaagttaggacaagcagcctggtgtctgtcgcggtcgcgcgtgcacgaaagatcagtgcaatgaccgcagtgatcacataatcgtcaaagcatcaaatgctcgcgcgagactaccctggaacagcacatgacctctttgtgaacaaaacatcaaatgggaaaaagcaacgctgtgcgagaactaccctaccttatttatgcatgttgtgcccaactcactcctccggaggtacctcagaatagaagcgatgatctggatggaacacctgattgtggaggttgacactctttccgcgtccttggctgactgcgataacgggtgacccaatccggcaggcggtgaagttcccgctccccctggcaccacagccggattgatctagcttcgttttggctgacagagcatcatcacacgctgcgacaccaccgagggctcccacttaagttcgtgactgtagaggccatcacaacttccatgccaaatacgtaagctggaccgtctacttcgagaacagctgtcgccaagccctcttcggagactcttttagaccccatcgacccgcagtctccgccggcgcactcggtcttttcggtcgcgcatgctgcttactcgctgcacaggattattgcacatgtcgcactgaagccacaatatccactccccgagcatccttatatcgtcgtttgactcgacgaccaccgccacaatgttctgtctacggaggtaactatcgccctacgactcccagtcttcagttttctgttcagactgactgacaatcaattagttggctcccgctcctcttcatccccaccaacgcctcgccctccttcatattcctcttcttcgtgtgcacctacttcctcaacaagccgtgcatctactgctcgatactcctcctcatcctcttcttcacgtcgtgcaactggtccgaccgatgcttcttcgacttcagtagcgactggttccggccgcgccccgagacaacacccgacgatgggtccctcgtgatcgtcgagatgttcaacaccaccgtcaaggccctcgctggggttgccgccgtcgagttgcgcgcgaagagggccgagtggaccggcctcggcatggagtggctccggagcctgctcgggaggcgggagtgggcgatcgactgtatggacatcaagatccgtctgtaagagtacggcatgtttgcttggagggcggagcggccaaatctagaataacgcacaaaggtggccggatgatggatgtatattatgaatcacgagacgagcccgcgctcttgggtagtagctacattagggaaaaaaagatcaggaaacttcacaggcggcgtacctggttttctgggaaaggcatcaggctacgacaggatctctagcgtgctaggggttgtacaactgctagcgtacttctttaaatgtcattcatatccaattatcattcctatatcattctatatacatcgtccatttccatcaacctcttccacattgaagacttgcaactcataagacagacaaaagtaaaaggaaaaaaagagttgcttgcaactcatcacactcctcgtcatatgctcaaatggagaaaaaaagctgcaagaactcgctagaaaacagtcgcgaacctcatagttcccgttctacttccttcactgactcctccgcctcctgggcaacctctaggaccacttccagatcctccttagcggctgccagagtctcaccatcctcgagggcaacattcttctcagtgacttctgggatctcctccaccttctccagaacagcatcctcgaggacagtctcctcctcgacagcttgctctagagcatcttcaagggtgacttcgtcctcgacggccttctctagaacagcatcctcgagggtaacctcctcagtggctcccagagtctcgccaccctcgagagtgacgtccttctcagtggctcctacagtctgctccgtcttctccaggaggccatcctcgagagtgacctcgacatccttttcctcgatggtctcttcttgagcttgggtatcttgctcaactggagcagacgtttcagtggccgcctcaggcgccgtcaccgtcgccgtctcaaccatcacggaaacctcagtaacagtctcaacaacccgaatgatcttttccgttgctgtcgtctcatcctccttctcgccatcggggtcggcattctcagagacaacgtccgccacagaaggggtagccaccgaagcagaagacacactctcaacgctcggcacaacactggtagtctgctgctggtcggccgcccgctctgtcacagtcacggtcggtgcctccataacaggctggaacatcagcgcatcccggtgcgcatccctagctgccccgacacgcagcgcaagcacaagaaccaagacacccatgatggcaatcatgacgttcttcttatcctgcatcatcaccttgaacgcctcgagtagcagccccggaagagagtccgtcttgggggcctgctggcgcctctcttccctccgggcgtacgcctcagctgacggggaagccggcgtatccctgtgcgtgtactcggaggagggcatggtattctccgccgcgccgccgtgctcagcatgctgacccgagggcgtgtgtccgtaaatctcccgcagcctctgctcatctctccaccggcgctcgtcctcgtgcatcccggggggaggggccgacggcggcgcagacatcatcactcgagtctcaggaggagggggcgaggagggagcattgtagatgacgcttgattcctgttccaggaacgaggcgtttggctcttctggaagctctccctcttcctcgtcggcttggtgcagctccatcgccttctcctgctccaacgcgtggcgggaaatctcatcctggacggcgggctcgacgatgggctcgagctccacgtccacacgctccatctccttccagcaggcttcccatgctccggccttcataagaccgttactagcatagatcttgatccggaacaccttgccggctccgagagcatcataccggatctcagactggcaggtcccgcaccagtgcgtctgcctctccagagcggcggacctcaagtgtctgaggctctctgggtactcatcctcggtatcagactcctcctccagcgtcatctcattggacgggccgagataatgaccacattccaagatacgcgctctgcgtctcagaggcagctccagcgcttccaggagcctctcctccagaatctcaaagtcctcctggggatgtgggaggagaataccgcgttcgcaggtcgtgtcgcccatgcgatcctgaagctggcgccacgtgtctctaacattcttcgctccctggctgaggtcatccgggtgcgcattctcaagcacatgtccccagggccactgcagaggcagaagcgtcacgtgcagcagcacaagaggcggcgtgtttctcttgaaccggggtggagtcttcttgggggagtactgcatccccgacatgggggagcccagtcgcgacacggtgggaaggggagtgcgcttgctggatcggggggatccgatgactgagggcggcggagacgacatttggagtgctcgcacggaggagggagatctgaagggtggccgaggcgtcccccggacggttgggataaagtcttcttcctcatcctggtcgtcctcgagacgcgaaaaatccgacatccttgatgatcgggtggacctatggcggtgcgtcaccgtatcctctaatttcctgtgctccgcttcagacatggagccgacagaactcctggggctgtggtcgctgaagacatcatcgtcgtgctcgttttgtgagctgttgttgtcctcagcttcatcggcagcgccattgtggccgagttcctcttcctcgtcctcgacagtggctcggaagtcgtctgggacgggagtatgcatgtcggatggacgggcacttggaggccgggaccccgagatattccttcggtaatctttgatcgactcgtggtcttccgacggacgggcatttgtcattctcgaatttgagcgggtgctgtggttgtccttgactgagtggacatccgatggtcgggcatctgacatcctggaatccgagcgtacgctctggttatccttgatagaggcatgggcatctgattgtcgattgctagaagcccttgattccgagcgactgctttggcgaccatcaaccgactcaggtttgggggaaagacgacccttttgcttttcaatctcagtgatgatatctctggccgctttttgaatcaaggcctcggtcctccccgagcttcggcggtcagtgctgtaggatacgccggacacggcagactctcgccttgaagcagaggcatctgagccgtggtcccgagagacggccgagtatgcagactctcggcgggatgccgaggcctctgtgtattgatcatgtgtacttcctgacattgttgactctctccgagactcggatctctcagtgtactgatcgtgtgtgatgcccgacgctgttgattctctccgggagtcggaaacgtccgtttgtcggtcgtgtgtgctgtgggaggtagccgataccgtagactcccggcgagaagctgtatcttccgtggccgcgtcttcatgcagactcgtctcagcaaatgaagcttctccttcctctgcatgctcagtatagtgcccagagtagtcggatgagtgctcggaggtcaaggatatagcagactcagacacccgtcgtgagtccgaggcatcggtgccagttctgtgtgaggtggaagaaatgcccgattcacggcgagactctgaagtctcatggccagaaagatgggacgatgtagtagataggatggactctcggcgagactcgctagctaccgtgccagacttatgtgacgaggtagcagaaatgccagactccctgcgggaggcagcagtatctccctcctccaagctgtgtgtactggaggattcccggcgagacgccgaatcttctagctctgagtccatcatagccttctcatctggctccatctcgcctccaaaagtctcgtcctcctcaattctatcgttggggtccggagcggcagcggcagccagcttctccttctcagcctggagatcgtccattatggaactgattgtgtggccggcctcgtcttcgtcgcctgtctcgttgaccagtgtgctcgatttagtcaggtttgaatcggttgtaccattaaagaatcttggtgtgtggtagtcgtagccgtcgttgctgaagcgccgggcgtgcagtgcagaagcaaagtccctagcctcggtctcgtccacttcgctggtggcgggcgggtcttcgtgtatttcaaagtctaggtcccgttggttttgttgtcttctgttacgccggggcatttgatggaccggtctggcgttcatgcaacggccagagttttggtttattaagagggtggtataaacaatgcggaaaaggggggcgggttttgcgtcacacagtacgacgagagagaaaaacaaatacggaactggcaccggacgagtcacaaaaacaagccttgcttttgctggacagggaagatggttgctctctggcagcggttgtggcgggagatggttggtccaattcgaggtgggcagggcctttgtttacgcccgttgccacggcgatggaaccgccgatctgcaccaccggcccaatgcgcatcacctcacatgtcgctgctcgacatagcaccacgttggccgtcgctactggctgttctggatcgatctctgcatggccggtccatcaagcacgaagtttatcatcatacatagtaagccctggtggcggtgagggcgatctcttggttggtatgcggtcagcggcaagtccctcagctgtggtttcacttctccgcacgcacctccaacggtgggcgtcagctattgggctacggagtggaatccatttgtccacagtaaacgagatgttgtgctacagataaatattgaacaaggtgggaaatattacgagaagagaggggcaatggtgtccaacagcccaaactaaccagcccaaccgcaataacatacatgtaatcgtcatcacacctccaacccttcttggctaccgggtaggtagtagggtgtttctaagctgtccaggtccagccatggagagcatacgtatcccgcaagaaagcgacagcgcgattccaggctcgctccttgatctcgggcttgacaatcacgtccggcactattcaaacgctgattagctcatctgtaatcaatatagtaacatcaggtcgagataacttacactctagatacgcatggttctggtccttctccaaaaacacctccaccctccccggctcacccgcattccgatcttcctcgttgatcctttccgcaaatgtcatctgctcctccaataaaatgtctatcccaggaacacacagcaggatccgtggcggcagcgtctccctggccgccaacatgggactcagcctcgggtcgtcaaagtgcttcttcctcgcctgctccggatacgcgtcaaacagcggcatcagcacggccacagggtccttgtccggcatcccctctggcctgggcttctgccacgggctcagcctcagctcgagcaccccgcagaagagcacgcagcccttgaacgccgtgcgcgacgatccgtgacgagcgggctgctgcgtagatgcgagcgccatgttgccccccgccgagaaccctccgaccgtcagaagctccgggttggcgccccatcgttcctcggcgtgctcggtgatgtattgtatcagggcgtccacctcgtcaatggcggtgggaaagacattctcgggcgcaaacgggtacgtcagaccaaggaccacggcgcctgtctctctggccacacgctcgtcgattggcgccgtgctctctgactggccgccgatgaaggcaccgccgtggatgtcgatatggatgggacgtagctgacggcttgtgccggtagctgtgccgcctgtgtgcttgtagacgagaacccgcgccgtcttgcctggcgcaaacggaagccattcgacagtgaacggccgtgagaaaaggtacggcactgagctgaccgcgtaagtgatgagtgaaagtggctgcaggaggagaaggcgccatcgcaagtcccaggcaatgtttggcttgaacaaagcgacaaggccgggacgcagccagtgatgtagtgtgtaaaggattcttgaagccatggtgtattagtgagagaaacctagtgagctgaaaggtgtgattttttgtacatgagcagattcatgaatgcctcgagtgagtcatgtctatttaagcacagaaagctcccagctcgatgtcaatggctggcgaccatcgtctccatcttacttggcgtcgcactcgtcgtattgatacttgccttagcgagtctatctaaggtcaggacataggctagtcgatgacggacgtcaagagttttattgaacgactgggtgagcagctgacacactgactcatccacgcctggagaatccaatgctgaattgaaggtgacagccatcatttgattccagctacagtttaaagctcacggataagtcccacagtccgctgtccattccataagctgaagcatacatacaatcgaggaggggaggatagatgctttgcctgaagcgacccgagctcaagacaagattcaagttgagagaataacttgtagccccctctcaagctcatatgttggcggcagaatgccgttgcgagtaaaatcaatcagttgactgaacttttgcgttacttcagttccctactaggtcatatggcgcatctcttcgttgaaatctggagttcgttctacagctttgagcttctggagtcgatgacttgtttgaatctaagtacagtcgcaaagaagaatgagggattgctacgaatgagctcaatgggccggtcctgtccgtggtcgagtggctcagtatcccttcggtctgctgtgcgaagggaacttgacacctcctcgtcggtgtacggaaatttttgcccattctcgggtagtttgatacaatcaagatcctcttctgggcgtatactgcacagcaggcaagcgactgcctattccaataggtgtagattaccaaggcgcttcgagatttcgtcggaatgtgctgtaatacttcgaatccaattcagggccatcatgttgccatgtagatccgtgggatcacggtcccctttttgcaatacttctcgcttgcctttctttggcacaatatgtgcaactctctccctggtctgggtaccgtatttcacgtaattttcaaattaatatcaagagcagccacctagccccatggccaatcgagagactcattcatatctcggagtatgcaacaagcaacacgcatgaagttagtcaagtaagttggttcttgagcaagggaagtgtgagattgttctagagagaaattacataataatccccagccattttctttcttcgtgccttgtatcgtattcattgccacacagcagacgctgaatgtgtgttctcctcgtaagcgtgatcatcattgtatgtcgcataaaaagaaaatggtaaaaaccctccctgaaaccaatccccctcaacactaagcgaatagtgccgatgctcactcaagaagcaaaaatgtcaagtctgttttcgatcccagtcatccctaacccaagcatggcgatacccgcgcttacaggtcctcgcagtagtcctgggtgacggtggtcgtgacagtgctggtgggggtgggagcggtggtgacaccggcggtgatgccccagcagctgcaggcagaggcgtatctggagccgtcacaggcagaagcgtaggcagggacgacggtagggacgttggtgacagcgcggacgttgcggcggagcttggcgggagtgtcgctgtcgacggtgacggtgacggttgtggtactgtagtttgttggtcagtaagagaaggagggacggctgggttccaagccatggagatatcaacccattcgctgatggccaaagggcatgtagcccaatattgaccccagctcatggatatatcgacccctctgttggtgagaagagaaaagaaggtacatacacagcatcgggagtaacggtagaagtctggaagctggtgcagtcggccttgcgagactcaatgggactaagaccatcacgagtgccactatcgatcttgttagtccacagcattgaagattgaacgacaggaggttcacttgcgtcacttggcgggcacagttgtcaccagcgcagtttcgaacctcgaggacgccagccatggcggcggcaacgagggagaggataacggcggccttcatcttgagaggtgggtgtgcgatacagagacaggtagtcgagcttggggacgagttgaagatctgatctgggaaacttgaccgtaaggaaggagagacgggaaacccagatgatgggtggcacaatggccctttatggactctgtcgtggttcctgctggctggtatccgatgggaagtggatagccaacgagctgggcgggcatgtcatggatggcatcagcgtagcaaccaccaagaaaccatatgcctatccccatacaaagaccctactatagctccgctttggagcttaacaggctggacggggcgtgtgaaggcatggggacccaagctgccgagcatcggctggtggaggtgtgggtggcaggtactaaacagattgtagtgtacgttggtcaagtattgctctcacttgcagcaattcagagaggcaggcactctcattaggcgtcaggaataaggaagagaccgttcctgcgctaccccaatgcaggcgagggtgcgaggaggtgggttcggccgaagcgcccgtatcccatcccacctatgagaggcgcaggccactgcatgagggcgtcaaggatcccggggttcagtggtttataaaagtacatgtgtgtgtgcactggtgaccgaaagggacaacggcgagcacagcactgctgagcgtgctcgtgtatagagagaggcgaggcggatgaacactccggcgccagggctggtgggcagcctaaagccggaacgaaagcggacaataagaataagatagagtgttcaacggttgatggatctttttagtgcgcaattgagctttattggagcgggaacgaatctgtagcctttggaggtcctccgagcggtccgctaacaccaagaggaaaacaggtaaactcgcttctgaaattgtggattggcgccaacgacgagcctgttttccagttcgtttacatagcggacggacaaagattcacagctacagcagggttgaccccatcaagtggccactgggttgggcgtatcgtaagcatcggccaccgttggcacaccccttgcttgcaggcctgtcctgaccctggtcggatccttagcctagaagccgactcgaattcagcctgcggaccatgtcatgcacgttgtattcagtgacctgcccggagaggctgtttgtctgcaggcgagcgaacctttggttatcaccacgacccgggagggggtcggtgactttccagagagactgtgtatccggacccccgtatcctgtcggtaaaatatggactacgtattcgtccacactgtgattctttaacacaaagcttggtgaagcttctttgctgggatgccaccccctctccgccaagcatggactaaggtgagcctgggtgaacaggtgagaagaagggtcgggagaaatccatgcgagcaagagcccagagcggcgggtttagcctgcaattggaaccgtgaactcatttcctccaaccattgctctcggttattcttgagcaagttcctcgcggatctcataacccttgaccggcatctcatctttcccacggccctggatatttagcgatccagtgctttctttcgcaccgcggagcaatccgctgagtgcacttcaggtgagggataagcagcgataaccacagcagcgcctcaacagacattgagggacagctggcttggacgtcgaagataggccatgggcgtcgagtcaagggtccatgtccgggcagccgatccgaactaactcaactacgtagtataaaagctagcgagctcttggcagaccttatggaatgcgccgatagctctctttatccgcccctcgagaggagattgggtcgtccctctcgattgacactcgtgcccagcgccactcccgtacaacggtcggttttcttagcttgacatagggagctagccgatcaaaagtgccgccatggtgacggatcgcaggctgggaaaggcaaccgctgatttgttcattccgtgactgaaatcaagacccatgaatcggtctcagcaacgccgtcaacccgagccgcatagattgtctaaacaccgaggaaagtgagctctagggagctgcaattgcttctggtcgagtagccgtggaatcacagcctctgagcacaatatcatataatactgaatgcactgctaccctggcccaccgcattttctcagcaacctgtccgaatgaggcaggctacaacacgaacattggcgttgccaatgggttagttctagagcacgtggcctgctaaccagtttgctgatgctttgcctctgccctccgaatgtgctgagtctggctcccatggtgctgggcgcggcgcaatcaggaagctagtatgtaggaaccttttcttccccagcccttgatacggacgtcttcatctctgggctaaatcgctccgggaaggacctttggctggccttgcgatcgcgtcctcaccgggccttggcctacaagaccttctgtttctggccgttggttatccagcccccgccaccggagagcgctggcgacaggaaccgagaggaacggacgccgtgtcgctctcgccacaatttagattcgtgtccattccgtcggatatgccctttggtaaataagctgataagcttgccgagagaaagatggcttttggcagggactaggcctgagtgtgagtttgaatgggccatgctcaatgataagcaatggaacttttcacttacattgctttctacccgaatataaggtacctatgttgcttacgagtctagcgggcgcgtcattgaaggccgcatcacattgcgaccattggcattaatgaaggcccaacaatgagtcggacatgcttcctcatctcgcccggctgaggtatatcgtagaatggagtaaacgaattggcaatcccaaccgctgctccatgtgcttgaccgactggaagtattgcagacctgtatccgtcttggccaccgcttcagacggatgatctttctccagaacaggctcagcccccccgtgatgtctttaccccacgccgacctcattcgcgggccaactttccatcttgctctctgtttacccggctaaatcttccgtcgttgaggccgccatcacacctctcatccaccgtcgtccaagaccgtagtcctcgacccgaacattgcatgcgaggtgtccattgcaacgtgagtatacgcccaattgcatggccgaaaccggggatcgcaaggctggaatggccgcaacgcacatggtagcacccaggctcaggccagtgtctcaccttgttcggcatcgcccggatcgtcacagattagagtagaggtcgtatgttagagtgctactgcaactccaccatcccatttggctctgatcagcgacccaagataccatgtcgcgagcctgtgcccatctggtcagagtgcaatcgtaaagccaggccaagacgaggttatgcttgggccaaacgaagccgacttgctcagacacggtgcatgcggaccaatgacgccgagtcgcaaatttggacttggaggcgcatattaatttgcgcagcatgttatatacattacccggcgcggctttttcctcggtgctttctctgtccggtattgatgggcgagtggtgctggggtcggtgatggaggagaactccactggattatcaatgtcctgcactggaacctcaatatattatatctggaatcaaagatacgctttgcaaatgttgtcatcttatgataatgcagtaaagagctgtattttacgatgcgacttggtcgaatgcgtttgctttaccttcgcgaaacatcgcgagatctacatgaatcgcacttggggtgtccgatcagcagagagggcgagaatgaaccatcccacaggcaacaatgtagagatttcatctagcttgccccctctccaccttcttcccatgactgatatcccaatgattgctccctcaatctcccccgaacagccatcaacgcctgccccagcagattctcaccccagtgatcccgaaagttcattgcatgcttcgcggtgtatccaatcccccatactcgatccctcccagccgcctcacatagaatcctgtcccccgtgctgagtagcttccctcgaaggtgcctgttttgcccgaacttggccatgttcccttcctctacaacctgcctcttcacctggtcccagctttcgtctgtgaaccctatggtgcccttaccaagagccttctgctccttgggactgtcgctctcaagtacgcgattttgccgttccatgtctccaaatcgcgccgctttgcagtacatcatgaactgctccgcgcaattgaaccagatgagctcttcagaatcgggatttgaggttccctcggtatatgaggggtgatctaccagctgggcgatgcgcgcctttgagacggagaatttggctttgtaccactggcagaattcgccatacttctcgttcggcatgtagaagaagaggggttgatcgtcctctataggtgcggaatgtggctcgtcgtctcgttcgtcgtgggtagatgcattcgccggatcggtagccttgcggccggctcccttcttcgtttttgatcccatgattgactgatctggcctgttgcatgcgtcagtgcatgtgaagaggttaatggtactcgctgggttggtgtctgaaaagttggattggatagaggatgagtgcacgaaggaagctgtgtgtttgttgatacagaactctagctaggtagacgaaagagggcaagatagagagggatctaatgagcggctcgttccgacggcaagtgagtcaccgatatgaaggtttacaaagttttgcctccgcggtgtgcatcttgtcggttagagttttgggtgtgtacataagtcaactgtgccgactgcatcattatggctcatccacacctcacctccctctaccagttgacagactagcattatgatcaatacacactttgtcttcactataaatactttcaaccactcccaacagccaagaaagcaaaagacaggcacgcaacggcagagcgggagaggacaccttcgcccttgaactcaaacatgatctataacatggtataaaacagtaactcaatggtatttatgcttagtgtatgataaaacccaaaacaaagtgaaccaaactgctgaatgccagcagcacgtttagatataacccaatcatctcatcctgaaacgccttgctgtgctcgtcatctggcacatcattgtaattatgtcccttgtaagcgccccccgaaatagaaaatccatcaagaactcctcgcactctgcgcaatggttgatatcgtttctccaccccagagaaaagaccggaaaggttggcactcaatgacataatcgaaaggaaaagagcagtagggaggatgcattcccccccaagccgtgacaagagaggaaagaaaacccaaaagagcctaaaaaccttgctttacttttccgtttatcgatgaggaggagggtagtaatcatccccctgcgcccacgatggtttcctctgctgaggccccagcgtgttattcggcgacccagacgtcgacgactcttcgttaatattgtccagcccgcccgtctcgatacccttggcggtaccgccggtcgcgctcctcatacgctgatggtggtggtggctctgggacctcgagacgatactggagatgctgctgaccaccgacgaccgccgctggtcatcgccggcgaacgtggacgacccaggcgaccccggaagctcgggcacaaccgccctcgagtccagctcggtgacgagccccgggctgaacggctgcggcacaccctgatgctgctgctgctgttgtccaaccccgccgtccgacccgtccgacgcatcgctgaagctccgcacgtgggtgtacccgccgtacgagtcgttgctgggccggtcaggcgcgatgctgtaccccgtcgactgctggctcgtccgcctgggcacctggaccccccctccgtggtgcgggttgatgtcgaagtagccggcgccggcgccaatgtcgggcgtgctggccgagacgctgggcacggtgctgacgggctggtagtggccggcgaagctggtgggcgtctggcccgtcgagctggcgatgtcggaggcggccttggtggtggggggcatcatgagggagtcgacctcgaactgggcgttcttcctctggcgcatctggggctgggagccgcccgacttggagctcgcgacggcggcgacgaccttgttgaggtggcggatgacgatgaaggcgatgacgatgacgaggacgaggaaggccacggcgcccgtgacgatgccggccagctgggccttggtgaggccgccgccgccgccgctgttatcagaggagctggcctcggctgagggagtggctttggcgagggcggaggggaagtatttcattacggcgtctgagtcgccgtcgccgttgccgagtctggttggggccactggtgtgctgaccgagaggctgcgtgtcgtgtaggtgctggttttgccgctctgcgtggtagtgatgaccatctcggaggtcttggtcacgggtaccgtcgagtagcattggttcacggcgcatcccatgccatttgggcagcagccgtagctgagcgatgaaggacagaggtattggctggcagggcagccgagagtatatggtgatccggacggcgggacacagttcccggcagtctggcagaggtagccgtcgggacagcatccacctgtgagaagaagagagaatgtcagtagggattcaccttggacaggcgcaatgggatcgctcacctccgtatttcacctcgcaggccctccaccccacgagcgtcccgcacgtcgaaggacctctcgtcgtagcatagcagctctctcttgcgcagtcgtagtcatcggggcagcatccgccgtcgagactggccgggcacagcttggacgacgtcccgcagacaccggcggtcatcccatcccgcaggtctagtatcgctcgagccgtgatctgggccttttcgattctgtggacgccatcgtatcgcttcacgtcaacggcggcgacctcgctcacgaccgcgaggccgagcaggagccccagtgagagggtcccccgaaccatggttgcgatccgagccagactcggtggtatcaacgttcgctttcttctatggatggtatcgttcacggtcaggacccgagcctagatgagtcggcttgctagcaaacgggtccgtctgtcgcttcggcgccgagctaagaggcaaagccgggtggcgcaggcggatgggcggtaagtgggagaagcttaaactcgggcgagcgaacgacgactcggggcaagcttcgtatttgggcgttcctgggaagcgtacgagaaaggtcgatcaagttttttttcgtaggtggcacgaacagcggcgggtttggatccaagtgggagggcaggctggcggagaaataagccaagatgggggcaagcagaccaggacgatttgagaaaaggctcttgggcagtcagcaaccagaaaggcttggctcgagagagagtcccttgccagtgagaccgcccatgcatgtggctccggcggcgatcagctagtgggagaatggatggtgtgcgattgcctctgctcagctcttgcggggcgcagcagcagatgcaaaatgcttgctgagagctgacgatggcggtggggtcgaaccagaccagggattgggaaaggcagcgagaggcagcgagagtcagacagagtcagagagagggaggggcctacggacagcctacattggctggatgtgagaccaacgtggatatatgtacctggacccagctgagtagggctggacgatgttgatgatctcaatcccaagctatgaatcggttctcatcgcggtgcgtgtattcctgcatgcatcgtggctggtgatattggcttacttatgggccatgtcagccatgtcatgtcctacaatcccacgttggcgataaaagaccagccgagacagatagcagaacgtgcctcctcttctgcctgccttgtccacgtagtcgtagtcgagcgaggtaacgataccgtaacatagacctctgggccgagacctcgaggggggccatgcacatcgaactggggtgggggccgaaaagctggaaaacgccatctttccagcagcaacaaataccatgcggcaccatcaatcaccattcgaccccgggggccaagccagccaagcctgtgttggtggtagccgggggcaggggggaagagggacgagggaggggcctgttcatgtgcgtgtccaacagcagcacagactggagggtccccaatgagagaatgtggaaggacggccgccgcattggaagagactgggccaatcaactgccccgttgggatgcatcccgtggagaagggagggcaaagggacttgggtatgcgtgcgtgtgtctgtgctgagagcaatgcgctctctcgtccagccaaccaccacccctgctcctacaccaccagctagcagagttgactgcaagtctcacccagtgcgcgatctagcgatagggcgggggccctctggtctaagttgtctggtgcccctcgtcctggcttctgaggccaaggggcaggcggaagttggagccgcatttggcaccctctcagccagagaatcggtgtgcggcttcacattctgctacttgcggccaagggtctagtctctcgcctccactcggggacttgttggtggcagatggaagtctagctgccggaatggcgttgttttggaccaacaggtgggtattgggcgggagctgacgggaagaggtgacatttgggggccaagtctgcgaagcaatggtaccgtccgagcagcagctgccattccctcgtatgtatgtatgtacacgcacggcatgtgtgtatgtttgtgtgtatcaatgatgtatgcacatgcggatgtcgacgctggaggctcctggttgggcagccaagagggacacgagtggacagccagtgccacggccaatgagaatgccctccaggaaaggtgacggtaccgaacggacgcgatgcgatgtgatgggatggaacctctgctccgagcctggcagttgttgtcatccctccccatgccaaatcacagttctcgagcctgactgacctcgcataagcgccaagggtcagatggacccagctccgccccccctgccctgctgccctacgggtggtgcgtccatgtatgtacgtatagcctacgtaacgtccggaggtgcatatatagagtagcagacgtgatccgtatggttcgtatggaggggccaggcgggaagctctcgcgaccggagagagaatgccctcccctcctgaccaaagaagaatagtttactgggcctatgcgtgcagtgtgttgcatttcagcccgccgattgcatgagcaagcagtccgatgtagcctcgtcccaaagtacctatttacttgcatgagggcttgcccatgaagttcaaatcgcaacgtatgaggggagcagtgcgcgcgaggagagagaagacagatatttgcgcagttgcagcagcgggacggtccccatgccaagctgctcgcatcatgccatccacgggtgtttacgaagtttgcgacggcctctgtgatgccgaggggcaccgaccatttctattgtaaggatgctctgtccgccaccgaccttgtctcccctgtggtgtgtctattgatcctacttcaccgagagtctggcacggccctggctcatattccccttctcggtcagctcccacgtgcgggaggcaaaaccaagtgaaatgaagcaatctgctgtttcgcatcgcccaaaggggaatttggtcatcttggtgtgccaccaggggcaacaagtcctggactgtgcacaggctggagaaccggcgaagccactatctatttttttcaccctcatgccattcgctcaattcattctctgatcgatctgtgtcctacagcccatgtccttgcatgctctgccccgtgattgcttgatggggctaccacagccacatagcagcgcctgttatacatatgccgtcactcgtaatgctgctttatcacgtcgttgcgttacatgtgctcccagaaatagctgttcttctaatccattccttccatctgatatggaaatcgtcattgactggcaagtcgaggtggtttgcaccagtcacccgccgctagttgggacggatttccctcacccaaaccattgcgctatttttaacctgatacaaacaccatcgagatgctaagagtcgcattgccgtcgtggggggggggatggcctctttactgattggtgggtgaaagcttctacccgcccgtggaaacctgcctcttcccctccctccaagcttcttcccgagcccatactctctcgattctaggtacttttgcctaatcactggctagtacatacatagttggctcgaaactccgctacaatatatgcacatcattcgtgccgtgagatgttaatgtagcatcgaaggtatggaaatagaataaacgctggactaagccttcaccagagagatgacaggcttcgccctggcctttgcgtgaccccaaacaccggtcctccatccggagcctggcaagcgcagccggtcccggtggactgtagggctgccgatgccgatgccgtttctattttgatcttcaactacaccctcgtagactgacaggcagcctgttgaccgatctcgatgtgtatctgtgatcccaggcagatcccgagagtgaccctcgcttgcctatgccttgtttagtgagctatgccgccgcgaatggacgccatggtcatctagctcagccgaccaggagtattgttcagctcgttgagctaatgaaatcgacaacccagattggggaacgtgttcctggacgccccgaccaatgacttcatattggcttgggtgatcttccgtaggccgcgctcctgggaacaaagggagccacgaggacagaggcctcgggccatccatccttgacccaagatggcaatctttgacggatcttcatgagcgctaaagacgggtgtacagacacgtggcatctcaattgaagctctacttgagacggtagattttgaataaagagtgaagcaaatgacactacacaaaggaatgtccttagtttgacgtgccaccctacgcgtagatactagtattgatcttctggccctcgtgacgaaacatccaaagtgcaggctcagcctcagcgaagggctgaatctcatacgctgtgggagaactggcggtcaaggtcatacccaccgatcggtgggtgagtccatatctctggctcagccatcgccgcgctctatttattcttggtggaatagattgcttatcgcatcgaatgtcggtctggtatgtctcagggcacgaagccagactccaaccggtggcatgagcatgagacaccaaaccaagggctttcaaagtgccgtcatacggcggcaggagaagaacgtaatgacctcatagaatgagttcaaggaactttgcttatgtgcttgcctgctcttgaaacgagcaaatggttcagtaatactgcatcagcgtctcagacctcccgtcacgccagaagctcactcaatagttgcgccatcatatttctttctcctttactttttcctttctttttcctatcctatcaggtgcttgtaaattaagaacgcataacttttgcacatgtcatttggttacattgggaagctatcatttttctagcagaaatgacaaaatttatacgaggagggagttaccacgcagccaccagaacaagctggatcgtttcacttggcagaagcgcttttcatctggtgcccagattgcattcaattgctctggctctagccacgaaggaagtttactctaaatctagcccgcgaaaaatgaaagaggacacttatcaagtcttcatctatttgccaggtgacggcgtccatggttaatgaatgagtccttgaagagcagctcaaagcagcgactcggcgctggtcgcaaactctcatcttcccgtcattttccgtcctgccatttgaactattgacggcgtgctgcaaggagtgcttcatttctagtggctagagcatgcgtcacatggttggctgcctaactggctgcatgcatggacttctgacagtgaatttcatccctttcatcgctctcatcacggacagcacatgatctagcctggctataaatatgttttcctgagaccgacgacccaagactattcatcaaaaatcatccgacaattgaaggcgacagcatcaggcaccatgtatttccagacgctccctcaagaggtggtggccaagatcctcgacattgtgcgcctaatagagcctcacaaggttgatttcttgaaccagcgccttgtctgtcgtaggttcacactctccctctcttgcaaggacgtatattgacctggaataggacactttgatgaccagatctcccgcctcgtcctgaaacacgccgagccactggctctggacatcggccgtagacacaactggcgaccgggcatcgaatggatgctcatcaccaaagccaggatccatttcagagacttcgtggggcccttcgcattcctccacgatgccgcggcctatctggcggcgaagaacttgatccccaacctcacacacgacgatgccctcgtcgctgcctgccgcgctgtggtctctgcccacgatcccagctgggtcgtcaaccatctggtgacctgggagcttggcaattctctgccagagagaatctggccgctgagaagctacacttctaaacgattgaatccagcatgggtgcctgtttccgaggttgataccaacattcatctcggtacgctccaggtgctgctcgcccatgggaatgccttggccatcgagcaattcatcaggagctgtggcttgagcaaggggcatatgcagtctgtccaccttgctttcggctcggtcctctctgtcgctattgtttttgcacgagacattgcaatcttcacgctcgtagaagagtatgggattgacacgaccgtcatgacggttgatggcaagagcaagaatggcttgctgtacgcctgtgagatgaaccgatcagcggcagcatacatgctcctggaagtcccgcgcgatgtgcaggtcaacttccaagatgcgctcgggcactccgccctgaattgggctgctcggagaggatgggtagaggtcgccgaagcactcctcgcgagggacgacatcgacctgaatatcgcaacgaagtggggagaaaccccgttgggcgcagcagccaggcaggaccacgagcatatcgcgcggctcctcctggacaagacaggcggcaagcctccgatggtgtacacgaggtactcccccatgtggcttgcttttgaatgcggctcaaccaacgtcgtacgcctgttcctggaacgacttgggaccgactttgaggtcaatcaagtcatgcgcaaaggatttacacctctcaccttggcagcgagcaagggctatacgtccatcgttcgcatgcttctcgcctttcccaacatcgacctcgacaagccgatagacagacaagcactcacgccccttctgctcgcttgtgccaacggccatgcagagatcgcccgcatgttgctcgaccgtggggcagatgttactcgtaaggcttttgggaggctgcccttccagatggcgatggaccacggacacgccgacctactcgcggtcctgattaacgatactattgaatcgaacgatgaggcccggacggctctactctggtttgctgtggatacgcggcatgagataggccttttgaagagggtccttgcttctgctcaatttcgccgaaatcgcgttgatcaactaggtagacttttggttcactcggtagtatatggcctcgtcgagatcgtacgagagttgctgtcccatgcagaagtcgatcccaacttcaccagaggcttcccgtctgacaagacaccgctacttagggcgatatactgcccagccgcgacagacctcatcccgcttctgctggcccgagaagacgtggatgtcaacaaagtgacaagtggaggaacagccttggcatcagcagctgctcggaacgcatcacccgccatagccgctttgctgaggtatccaggcattgatgtcaacttctgcccgacgcaatcaaagggcgccaacagacacctccgtatgaaccagcctcggaacttcttcccttcaaggaaaccacctttcaaatcttacctgaaagataacatctatcggcaggaaccccccctcctggttgcagccacagagaacaatattgaggcagtgagcctgctctgcgaggatcctagggttgacctgggcaccaaggacagtttcggcagaactgcactctggtgggcggttcgacatgctagccgcagaatggccgttctcattctgcgatctccacggatgacggaggaaatcatcaatgcacaggatgaggatggctgggccgcgctgcatgtcgccgcgaactatggccttcataaaattgtcgagaagctgctcgagcggccggatattgaccccaacctgcgtatttcagatggctggacggccttacatatgagcgcgggaaactgcaacaaggcagttacccgaatgctacttggccacccaaagatcgatccaaccatcaagttggataatgatttaacgccgtttggtcttcacgagggatgtgaatgtggtcttcaatcaatggacccagaaggggtgaaggaacatggtttggaacaagaattatcgaacagcgaaggtcgagctgtgagtgacgggagggaagacatggacatatcaaattgaagaatagtcacgagtaggccactttctttaaaatgtagcgatatggaatgaaatatattgtctctcgaccgtttactattggctctgaataatatgtcaatactatgtaggccgggaagtaagctagacgattcaacaatttcaatttcaatttcaattcatcctgccggcgtggtagattccggatcaaaagttcagcctgcgcctttcctcctttctttcaacatacttggcaagattttcttcggcacaagcatcggccctcttgatcatcttgcctgctatcctagtccaagcccagggccaccgatgtcgcatgcgaaccctcaagaagaagcctctcgcgacaggatgtccgccagcttgagcccaatcatatacgtaggcatagtaggccatgcgccgggcgcgcgagggaagacagacgcatcagccacacgcagaccttcgacgccctgaacgcgaaactgggagtcagtgcaggcatcccggtcccccttaggccccatgcgacagctaccagtagcatgatggccaaacgcctcgtccttgagcgactgccgaagatcctcgccggggccggggctcactatcgtgatgggcgcccaggtctcgctcgtttggttgaagaggttcaaggccagctcgccagcctccactagggcctggagatcccgttcgccagcatcgccgacgaagtagttgaagtcaatcaccggtgtgtcgcgcgggttcctcgaacgcagcgtgacactccccttcgcgtcgctaccggggcccggcatctgcgccagggcccaggagaaggaagcaggagaagcagccgggcgagaaaagccagggtagaagcccgtgactgcggctcccggggcaccgtagagccacagatccggatgctcgttgtcgctcacgctggagcgatatacgagtgacagaggggctgcagcttcgccgtatggtccagtgccactcaatagccactcctggtagcatggatcactggccccgaattcgaatgtgcaattctcggagtagttatcccagtcgatagctgcatcgccgatgacggtagcttcatagttatcctgcaagaaggccccctagagaagattagtgaaaggttcgtatgaaggcagtattgaggcacataccacggcgggaacatcagcgacaacgggtatgtcaaacttctcgagttcttcacgaggcccaacaccactgagcttgaggatttgcggagtgttgaaggagccgcctgacacgatgacctcccttgaggcgagcacggttctagattcccctgtcgtggaggaatcgtatcgttggtcggcggcataaagcgcatcccccaccatatactcaactccaaatgcccggggaacttcaccttgctgatcaaacaacactctggtcgcgagggagcgtgtactgagtgtcagcgggtattttttactgccgtcagcgttcttcgcattcagcgtgtccacgacataagtgcgcgccccagatcgacgcttggtctcagtaacagccgaaacgagcatgaaaatgccctcagaatactccctgggagggtagggatcccgaagcagtagatcggctaaagcgtcagtgctattggcctcaataccttcgacttctagggaagcctttgacagctgatccactacaccagctgatcctgtgagataagtgacgttgtttcgagagagctatatcaattagacactggcatcaagacacgctggggataaacataccgttataaaaccgtcaaagccatgacccggagtaccttgagggagatagttacatttctctgccttcatgaagtattccctcatggcagccgcctcaaatgaattatccccggttacttcgacgatataatcccactttgaatgtcgggttagcctccgaccatccttcgttcgagataaattcattcggtttcgccatttttttcctgtaataggagtgacaataagccaaggctgccattactcacctcatggtcaggcggggggccaagattcatagcattcacctgagtgctgccacctacagtggcactgcgtgggtaaacaattcccagcctagcgttgagtttagtacaagaagaaggccagtataaatatggaaacttacggttccgcaccctcaggcgggtttgggccgatatggtaagagccattactcatgagataggtgtagtgcggatcacggcacgcctgcgtttcgttgtttcggtagtggtggacgaagaattgccaggaagagtccaggccctctgctgcctggcccgaactgcaaggagatgagagttaaccccgccgaacttgtgtgattaggaatagattggggatatgacaaacagcgctggaatctgttgagtaagttcgtcaccccgatcttcgcctgcttcgatgagaaagacagagtgaccctttcgagccaaagtagccctgtagcaaagcaattgtaagcttaaaactgttatcaagttgtggatatttgaagtaaagactcacgccactgctcctcctcccgcgcctgagccaatgacaacatactcatactcagtttcattcgtgactttgggagtcacagttgcccaagccgtagctgcaagcccactcagaaagtaggatgatctcatgttatcgaagtcgatgaaatgctcagtattgtttggattgctgtgaattgatacaaacttgatatgagatacagaggtatttatacacaacaatctctaagatatactctcggctaacaacacttccgaacatcccggtgtataatttgaaaagacgttcaagatcctggagacggagttaccacttgacttcatgttaaaagccgaacgcttgatttcaagccacccttcggtagatgccacggcacaagtgcaacttcctggtacatgtacagaagggtccaaattgccatcactttatttttagcgtaaacgtactttgaggtataccctgttctagctccatgccccttcgaatacggtaggctctgtcctcgtctcctacctaggtgtccttgaggctagctatacaagcttcaattaaggaaggtatcctatggagtgtggatcattaccgcgaacccttgggtgggaactagctaggtgtttccaagggaataagcttaccatgcaacccgctcactgtactatgcaggggatgtccctcggacttaagactcatcatgagaacaagaattcagctactctgtttcaacgtcttgttagtgaagaggctaaggggcaagttttggtatcgtcaataatataaaaatcaagaatctacacatatcgccactagagtatttggtacaacccagtacagcgctcaagcgtagccttgatctcatcatatacatggttgaggtacaagtcaataattatttctaaaatcttacgcatagggttgctatccacggattgtctattaatgttcatattgcattcatagggatagatatattatacaatgtgggaataaattttgcccggatacatggattgatttgacactggaacgtgcacgtcgtggtgtaaaaggtgctgcatataaaggagattccgttctttgactgcattattaaaacctccctcttcgctggtgtgactaaacaactacatacaaattgctgcaatattgttcgtcctcttctcaatctcaatcctctcttgtccgattactttcggtgccccagtctagcgcttagggagcctcatgcacatggtctgcggttaactcgttgcccgtcatgcgaggatgctggttaacctgatcgtagtgaggtggcaccgacgtccgctgatgttggccgtctgtgatgggcttgtcacctacaccaggcgcagacggatgagcgttggcgcccctattggccgtttgtaggtgtctccagaagaagaaagcaattacagcagccacaaggactccagcaagtgttgctccgaccgcgatcccggcgatggctccagccgaaagcccggaaccggatacttgcgaatctgcagtggtggttgcagccgtgggagcagcacttgtcgatgagctcgacccggatgtcgtcgtcgtcgtcgttgttgtttgaattcgagacacgttgaaatagtgagagtccgcaatttgctcttctttcgaggcgtcatagattacgagccagaagatggagttctcgccctcaggaggcggctcgcctctcaaagtctttgccatattccaccggtagctcgtactggaagtgtttcctagtaggtaattatcagcttatgttctttggcttgctttcttgatgttgattgcacgagtcacagattcatgtacttacgaaccacataggcgctgtagtatttgtctgacggggcggggtatttctgaaagatgccaatgtcgacatatgtgacatccgactcccacaagaattcaacctgctggccctcctggtatatgggattttcgctgtaatcacctgaaatgccgccagaggggggcttgttgaaaatgttcctcgatagaacaaggtcacaaagccacagaaagcccgcggcaaacacgactggttgcatggttgactgtttgtaatgaacttgaagacacggaagaatctgagaacttagtcgcagaggatgggaggacatatatgcaaaaccgaagagttcgagcgggcaatttgctaaaaggggagtaacacagtcagccctgaatggtggctgattcctgtcgtccaaccaaaggtggcataagggcacttgtgataccttggatggggacagcctcatgcggatatccactctattattgtcctgttcaaatgaaacgatgcatatgtgtgcgtaagtgcagcctatcgggtccaagtaaaagtgccaccgggatgattgatcggcataagtactcttggtagtctgacatgcttcttggaagtgtttcaggttctcagccctttgtgcgaccactttgacgaagatttttcctgctctttttccttcatcatctcgaatactcggggacggagtcgacctctgtgcggcggtctaggaggagaaagtagtcaatgcgtagaagtggtagaggtacagcatttgagtcaacatcactatgtgcctcgtttgatgcttcagcttcatcgatgccagcattatcgctggtgtgaaaattcggttaatcatctggttctcgagattcgttggcttgaagagggtctcgtaggagttcagtaacaggtggcgcctgtccaggggtcgctggggattctccagcctcattggcgtcgttactgttgttggtttgggcattcggcatctcttcaggtcccgggcctaaagcgtcgttgatgcgaggagatttgggggggggggagggtcttgggctccgttgaatccatgtcgaccaatatcagtatcatgctggcctaaatgctcattccagatatcagcggcgatctcttcgatatttccatcatctgtgggcataccggggggccaatccagcttgttcgttcgccacaatggttgattctaatggaccctcttccatattctcggtgccattgttcatctgttcagattgcgtgtctgaatctgggtcgctttctgaagaagtcgagaacatcatgcattcctccaatgttctttccgatacgtagccatcgttgcgagggcgtcttcttttattgggaggcatgtggcgtcttgtaacattccctcgcctgggaattttgccattcggttcgtttccttcagtcgatcgaagcctagaattctgatcgggaggggagatatcgtcagtcgcattgttgagttctgcaccatcggattggccgccctggtatatgtcagcgttattctcttgcggccgtagaggtcttacctggtctggagtattgtcttgttgaacagacgacctttgcccgatgccgtcagcaatgagagagggcactgaagatatacccaggccctctgtgtcttcttccttggcagcaagggtaaaattggaaatctgctctattctcgggaccgggcgcttctcgggaccgggcgcttctcgggaccgggcacttctccaggtgcaggggcaacaggttgtaggacagcaccaaaaccccgaagatagagctcgttcactgggcaaggattagctgtagagtcgccgtgacttctaagtatattcttagttgtcgctctccttcttaccttttttgctgcagatttctattcatttctattcagcctccataaaatctgttttagcagtattctgattcttttcgtgcatcttctggtaagcacaagaacgcggcgaagcagaagaacgtaaggaacgagaagcacttacttacgttcgtcttttgatgagtcatcttgttagcgtttgttgagtcctcgctgtttgggtagttgtctggccagtaccgggcgccattgttatcatctagcatttgatggtctcgccgaaagcttagaagatctggcccaggagtgccttcaggtgagacatagctctttctgaaggcgtgtacacctttgagccacccgcggttggcttgtaccccggagggataacccaaggcttttctaatagcttgatgattggttggctggtttttagtcagttactcatcatctctcctacgagcgggcatcttgaatgtgttaacccaagagtatagcaagtgaggctcctgtggagtgtgcttgatgttcgagcatttctcagaggtgaggtaaagctcggctcttcaaaccattacccctaaggaacaaaaagtgaacttttccaatgtggggtaggattgcgtctgagagacagaacggttagaaagaatgaacggtcagagatgacgcgccgagtaatacggaaattggccgtcgacgttgcatggtccacctggcttgggcagccaacaaataaccgccaaacgcgaccctccaaaacaacagaaagtgtaaaaataccgtcgtagaatgtagcactatgagacaatagactcttgtaagtttgatcttggtgttctcacgacggaacggccggtaaaaaagtgtccggactgagtctacaacgattctcacacaagaaggcgtatcagaaagttcctgtttgtacaaaagtaaagctaaatagtttgatgtcgaaggtctactataataaacacagtattcgcgttctatgtattgtggtttgacgatgagcgagtaattgagatttttaacagtagtcggggatattgctcttgtgttttggtctttgtctaagggaggctttccagaaaggccttaactttttgggaatacaataatctgtaggaaatggattctaaggcgaaataactggaaaggaggcaagccacgtcgccattcatcctcacttcccctttgctgtgcatgttgacgtcaggtgctgatgtcacgctcatttcatagaaaattagcctagctcagcctttagcggtgaacttgcaagctggttaacatggggcacaccggattattcaattcgttgtcgagatgccgtgagatacgaatgacccttctgccgatcgtattcaagctgtgtctattccggctttccatctggcaactatacaccaatttccctatatttgagcttaataagtcatcgtgtaatttcagatgacttcggtcgatccgaattggaaactgccaactggcgaagagtatgccttgcaagtactaattttaggtcttggctattggtcgatcaacaaccaacagcccactcacacagcgcttaactgaggccgctcgctgctgtgtccctggaaggattacatataaatttacaggatatgcggaaaaggaaaagaaagagagaggaagaatgaaaagggggagaagaatagttttcatctttgtacccgcgccgcaaatagccaacatagctgagctactgtcttcacagatacattaattcttgcaaccactaatggagttttcgaatggtctttaatcattcaacaacatggcctgtcctagacaagaagcgtgacgtagagatatcaatttttggcgtgctagaggctgagcagggcaccgatcctcaagaaacttgatgatcagcgcttcaggcccataaaatagacaagcttcaactcagcccgtggattttcatgcaaaatagtatttagttaagaactaatacgaggagagcccatggggtaaaagtcagcccgtctttaattagcttcgaaacaaatcaactcgtatcaaacgacaaaaggtgggtccactgtgccaagcatccttgtgataacttgaaccgagccactcgattacacgtaatacggggtgagatgataacgcaaccttcgaatgcagctcgtaaagtaccaccttgataagcaactgccggaataggccagggatgagcagcggcctgattaggccagtgatgagcaactgcctgaataggccagggtagctggtttggcttaacaaatgtgctgttgcagttgaaccatggcgattgtgttatattgccgtggtctttctctcatctgaacaatgactgatgcttcatcttgagaaactcccctatcgcctccaaactactccagttacccatcaacctccctcgcagttaacatagtcttcgaacagtatactttcagcctcagcttctccaccatggggtcactacgcagactcttcatcttcctcaatatactcaccgttgctgcagtcaagagtgactctgtctctgagtacaattcgaccctcagcgatagcctggcttcggagacagaaaagccctcgctcgccactcttcacagcttgaaccccagtctcgtcgagacctattcgtacaaggagctcagacaagtcatgagacaaaataccgaaagcgaagttacgagaaccgagttcacaacaacagatgcggtttcagctacagatgtttcctcagaagtcgcttcatcagaagttatctcctcccaggatgcctcatctactgtaccaacgacatcttcgacttcctcggcgtctgtctccactgcatctacgacgtctgaaagtatttcaagtactacatcatctaccaccgaagcttctgttacgagtacagcttcctcttcatcgacctcttcatcgacttcttcatcgaccgtatcatcaacctcgacatttagaccaggcaaagtcaacacagggactgtctgcttcaccaccaccatggcttccacctcagcctgcgatgtgattatcagcaacgaccacaggagtacacgaacatgcacgcccatagagtttagtaggagctcatgttcaccgaatcttatatgcacaaccaccctggacgatgatatttgcatggagattcagggaattgaaactgcgggcattatcatcgctatagttttcgcttctcttgcagtgttttcctttgggggcatttgtgttgcaagctggaggcattctcggaaacagaaggctgctgctgcgaaggaggaagctataagtcttatgagagcagcgagtaagaagaaacatctagctacaggtatatagttatatgttatataatgcaagcttcctagcttcgttatacttgagttgtcattcattggatgccggtattattcgcaggtacagtaatatcaggggcagctgtagctaatcataccaaactgaataaaagaataaaagggtgattagtaattataagtaaagtaaataagctatttttttttaatctttatattagtaatataaatagctaatatcatcaagctactattactctgtaactactgattaaatagttaaagtagtctgtctacccttagaatgggatcttatttgatgtgcacaaagatcttccttatcgctggacggccgtaaccttcacctgaattggccccttgtcccaaagaaggaacgtcttctgctggtcccaatttttactttcgggcagcatctcaaggtcaaaggaccatagaaggcgcgccaagatgagtcgcatctcggcgtaggcaagactgttattttttgggtgacatggtcagcacctgcgtgtgtcatggaaataacgttggcggagagggcatgccagtgcttactttttgccaatgcagttattaggcccgtaagaaaaggggttgagcaccccgcggctgtcagacttgtacttggggtcaccaagccatcgttccgggacgaacttctccgcgtctcgaaagtttcgttcattgtggtacgacgaatattgggagacggagacactggtctgtttttgcgaaatttagcattggtttctgcctagagcatgatgctggattcacctaccttgcctggaatccagtacccttcaatgaattcgccctcaggtggagtgatcctaggcagacctgtaggtacaggtgggtctactcctgattagctgttgtggtggaggtaggtggaggagaagttcaagggcgtggactcacacattcgaaacccttcttcaaaaacagcatgcatatactgcaagtcgttcactctcgcgagagtaatctcgtcttccgactcgaacgtagatcgtatttcctcggttagtctgttgtaaatactggggttggtcaaaagatggtaagttgtgccgcttaactgtgtcgccgtagtttcgctgccggcaatgatcagaactgaagcattctcaacgagttcccccttggtaaggcctttttcatcattgtggcgaagaatgtatgacatgaaatcttctcggtcagttttacccaattctacgcgtttcaaggctgtctgttgggtgagctgatagtgttccttacccttttccctcacccatttcggaataatgagtgaacgaagcggagcaaggaacgtgtatcgccttacgacttggcctaaggacgctatacggagcacatcaaagatcatagagacccaagggtgatagcctccagcctcaaggcacccaaaaggctcgccaaaggcaaggtcgccaatgagatcaaacgtagtgaagttataccatgctacaatgtcgatcgtctttccgttctttgcattctcgcgtgtcttggagataagtaagtcgacatacttcttcattatactctcttgacctcgcaaggccttctcggagaacgcgtgggagataagtcgacgcatccgcttgtgatcctcatgaggcgcaatgataatgtgagagttgccggaaatggtttcgcggtagactcggaggtctttgtggaatgtcttgttttgggatgtcttgtgcccataaatcgttttccatgaatcagcggtggtgaatgaaacgtcttcgggtccaaatctgacgacttggccatatttctcgtgaaattcttgcagttttccgacccaagtgccacgggagacatgatagaggtatggtagatccgttatagcgtacagcttagggccagggatttttgcaagaggatgaaagcacgcccggtatatagctaggctaagtacccatagaaccagcttttggcaaattagtgagccatagggagcaatgggcactgtggattggcagtacttacacttccagtggcagccagtggcaatatgcctatactgagcggagtctccattgtcaaccgggagcatgaactaaggagccgataggatgcagacgcaagaatgcaaaatcttggagctgtgaagaatcattgactaacaaataggagtggaagagtatggtatttatagaaaaatcgccaagccccagacgatctacccgctcggcaattgatgccagccccctacatctttgcacccaaaatccatgggatctccgcggagtttttggctacattcccttctttggtgaagcacttacaaggaacggaatagcattaacaacatatcaagcccgaatcccgatctcttgaccattgacagccagcggcgtttgctgcagtagggtttttgcctcactaccctacccctagattcgccccgtgactgacacctttccgcttgataattcccgctaactggtgcggatcgatgtcatcgagacggatatggacatgggactttgtcaagaaatattgattaggccaacgggccgtgttcaaacccgcacattccgtccacaccatctaccgaatttgcacacgaaaaaacttggaccacaaagagacactacgagccgtcatatccgtgcggctataatttccgaatcccaaaaaggcctgagggacttctgagttcctagccatgaaagttatagcatactgcaaagcttcctagcttcgttataaataagtcgttattcatcagatgccagtattatccgcaagtacagttatagcaggggcagctgtaggtaaatatgctaaactgattaaaagaataaaaagataattagtaatgataagtaaagtaaataagctatttatcaaaatagagtagactcaggttaagcttggagaataataagagaagtcttttgctaaacctttgagggacatttcataatacgtgactttcatctttgttccttgctttatgctttgagatgttcagtgatggagagagacagagagagacagaagcctgagtcgagtgaaacacacaacggacagtcggtctgggggcttcgaggtagcaggaaaaaataatggtggttgatgtgggggggatcggcacgccccaatgccggtcccaccacataaatgacggaatcgtctccggctgttgcaatcaccactcatactacgttaatgcgggatttcagcaccttgatatcacaattcggttcaaagcatctcatatctagaatatttaagtttgtcttagtataattatatgtatttgtaaagaattttttatattattgttatggttgtctataatgataatgttccctttgtcaagacaagttcaggcagctttttatcctttccattgtgagagtcatatcaatctctgccccaaactcaaggttattgatccgaataaaacaaaaattattgtacaagaagatgtcttcatttcccgagctatgtaacactcttatttactttcaggttggaagttggagtggtcattcttcagaggggagttggtatagggtaagcagcgtaccagcagctctgagtggtgtctagacatgataaagacccttatatcaatgagccatgtacaaatcctcatctattgctatttattatatgatcagaatcaataaattaacctcattgtgcgaagaggtgattcaattgaagacgtaacctaatcgagaacacccgtgatttcaaggtacctcaaataccaaggctcacaaagaaactctatgaacgaggagaatattaaacccaaagctatgacgactacaagaagcttgaaaaagaagtgcaactaagttcctgcatcttacaaggagatactcccattccgtagtcgaacttggtgcgaatattgtttccgtaaatttcacactggaggttcgcttgtcgccctcatgttgttgaagggaagaggtaggtttataccaaatgagaggcagaatggtcggaaagaagagccagctgctatgatcttgagaagcgggctaatctgctggtggtgcatgggtgaatggaagaatcaatgagtgttgtgttatggctgctgtaagcaaagttgaaaattggcatttatgggtttgctagtaaaaaatattgcctattatgtagagcctttttgcaggaatatggccgcattcagcttcattccaatcgcagaatgagcattggtgacgtgttctcgaccaggggttgagcgtgagatttcgctatgaaagttctaaggttggttgcggctgggagttatgctgctctttccgaccctttggacaaaagtcaacaaatatagtggcggttggatcactgaaacatcgaagtgcttcctttcctatactcaagagcgagtgtttatctagcaactcgtgggcgactaagttcatttgggatggcccaccaccctggccacatcctagtcgatcactaccggagactaaaatcatgctcgctaagtcggtcagccaatttcaaatggtgagctggcgagtggaggaatggcctgctccggtgctccctggttccggattttgctcttggaattccgccagctctgcttaccttcgctcctctccctttcactctcaacacaactttgccggccacaatggcggcctacttaacccccgagtcactttcgtacaccaacctctttgccattgtgctcttgccactgcttgtgacatatgcagctaccgccgtcggcaattgggggtaccgcaatggggacgcctcgagggagccacccagggtcccgtactggataccggtgatcggcaacacctttgggttcgcgtacaacacggagaagttccttgcgtcagtgatgtaagagatcaattccattttaccaccaatgtgcctgtctaacaagctgcagatcgaaattcgagaaggtgcctctgcgaattttcgtgggcgccgagcaaatgtattacatcccccagggcaagcccattctggagctgttcaaagcatctcgccatcttacgacgcattcactaaatgtcatgactttgcgggatgcattcggtgtcccaattccagatgtcaagctctatattggcgacaagtcgggcattaccgcgaaaccggcggctggatttgagggagccgacccagctcacagatttcacttcatcgaacatcgggatctgcagactcttctctccggaagttcattaaatgtcatgacaaacaattttatcaggctatataaaaagataatcgagaccgacgctcggttcgcaaagggagattgggtcgaaatcgataacttgtacacttggatgagagacgacattgctcatgccgcgttggaatcgttctgcggcgaaaagtttctcgagctgtcgccgacattcatggaagacttctgggcgtttgaccatgtccttcccaagttgtttaagagacttcccaggtggcttattccgagctgctatgaggcaagagacaaggcattcgcaagcgttctgagattccacaactacacgagggagaatctttcgatgacagacgaggagactttggcgaaagaatggacccccgagttcggatcaaagctgattactgcgaggcagaagctgcttcagacgaccgggttctcgccggaaggtgcggcagctcttgatctaggtttgatctgggcgtaagtgaatggaccatcccaccgaaagatttatgcggactttaacaaaatacaggctgaacgcaaacgcgatcccggctgccctttggatgctcctcaatatcttggttgatcctgatctgaaagaccgcgtaataactgagataagccctgcgttcgaggaagggtcgttgtcccttgatcttgagaagctctgctccggaccgctgctaaactccatctactgcgagaccctccgcctccgagtggcagcaccagtgggccgaacatcaacgattccggacctcaagtttggcaggtggcaactgaaggaagacgtgtgcatgctctccacatcttggtacggaggccgcgatccggacttctggaatactggacgtacgttgcctgacggctcagttgagcatcccgttgatacattctgggccgagagattccttcgatatccagatgacccggcaagcggtcctgttcgcaagcaaggtgcgagcgccatgacatctagagacaccgggaagcggacggcggacgatgatcgtaaggcgcgggctgtgacggatggcactcaggggtattggtatccgtatggtggtggcctcaacatgtgccctggccgccatttcgccaagcaagaactgatggtttcggttgcgctcgtccttcgcgcgtatgagattgatattgtcgatctcgagtcggccgctaaggtgaagccaaatatggagtatttccccttcggaaccataccgcccaaaggcaagattgcgaccagaataaggcgacgcaagctgtaagccggaggatatttgtatatcagagattcacttaaatatcgtggtcgagtgtaaagcgagtttcatcgatgtggcatgctgtagtcaaataatgctcttaaatgattgattattaagtctctaaacaagtagcctttagctggatatctaggactttcgaagtcgtatagtggtagctaccaaagatggatcacatgattctgtctgcagttcgttcgataatggtggtgctggtggtttgggatgtttacggtgataattgcccgtcgatggccgtcacatagggacatggcatcttatcgcaatgggagcaccaaagggtgctttgaagcccccgtgtggctttttcatatcttctaccttctcgaaactgatgcaagggtctacggaacctgtctctatctaagatccaactgactagcttccacgcagaaggcatatcaagtcatgtatggccaagaagcctctgtttcaggtctttaaaacggggactagacatgaatgtcatcaaaccggggtgcacgtatggatgagggaacaaggctcgatcagacatgattccgataaagagcccacactttcgacagcatattctccgagcaccgtctagtccttgagtggcaatacattgttggcggcccacttgcccttaccaccgcagtactctttgttacctgaaattcatatgagactgattataaaatggtgccgtatcattggatgggaagatttgccgtcgctatttgagcttctgttccgagtgtcggagaatactggccatcaaggcgtctctacagagacctctcagtctcattcagggacctcccggaactggcaagacccgcgtcatcagcttacatccttgctttaatcatccctacctgcaaccggaatccgactggacagcctaaaaacccgattgcgaagcaccgtctagccaataacattgcggtagttattacttccggctcctgttgttaggatgcaacacaatccttgttatcctccgcatgtctacgacgtaagttatggctctggctctgaaagccctcgcctgttatccagtttccattggctagtgtaaaaacccgattgcgacgcaaagtccaactaataagatcacttcttaatgcgatttgtggccctgcccctggactccggcaatgctggacccttgtagatactattgccatatcgaggtgtcttggagatggcactgccgcaagatgaaagactggaatagataatattcggactcatacgtgtataaagatcatcgaggacctcccgacttctcactatttctctaggacattcaaacatcttccctctcttgacttctttacaattgtaacttcaacgcgcactcaaacctaaccaatcccgccaatattgacttgctattcctcagaatgttgctcgccactctactttttatcggcacggcctcagtaacctctagcgaaccccttggcgacggcgggcctccacctggttcagagcctcttgaatgggggttctatgctactcatgagcataaagacccagcccagcttgaggtcagaggcaccatcccctcctgggtcacgggtcagctttaccgtacaggtcctggcacctgggatgtagccaacttcactggcgaccactggttggatggcttcagtcgcaaccaccagttccacatcgagaatggcactgttacctaccgtaaccgcaacagtacggatgatttgctcgactttgttcgtgagcacggggtcttcccgaacggtgctttcgcgactgacccaagcaagctcgtttttggccagtttgagacaacgtttcgggacgcttcgcactcccttggcgataccagttctgccaacgtcggtgtcgcttacgttgggaactggcctggcctggacaaaaacgcgactgagaacggttcctactatgatacgctggttgtaaccaccgacagggtcgtgatgcagcagattaaccccgtcacgttagaaccgattgagcttttcacatacgaggctggtgatcccctgcttgttaactcaggccgctccgcgactcaccccgccctgacaagagatgggaacgtgtataattaccacctcgacctggatgccgatccgcctgtctaccgagtcttcggtattgaacagcctgaaggaaagacccgtatcctggctaccattgatgatgcgcctgcggcatacatccacgcactttggaacacggacaaccatgtcattctcatcgtggtgcaggctgacatagtcaagccctccaaaggcaccattcgatcaaccttgggagaatggaaggaagaccgcccagtcctgttctacgtagtggacagacacaacggaggtattgtctccaaatactccattgatgagacattctttgctttccatcaaatcaactcattcgaggatgataatggcgacattctcatcgatcttccccgcatggacgactactccttcctcgatacctccatgctcgaaaccctacgcagcaagacgaacacaactgaaaagttcaaagagatggagggcgaattcactcgctatcgtctgcccttcgtcggaaacagctcccactcgtccaacggttcgctgatcacgcataaagcatcgattgacttcttcctcccatttgacgaggccaaccttgaaatgccccggatcaacgaggcactgaacggtaggccgtaccgattcgcctatggcctgcacacagtgcacaaaggaaatatgatggactccatcatcaagatcgatacccacgagaagacatggaaagtctgggagccggctgtccccattctcccctctgagcccatcttcatccctaaccccgaaagtaccattgaggacgacggtgtgttggcctttatcgttttggattctgaaaagaagactagcgctgtggtcttccttgacgccaagagcatggaggagattgcgagggcctatgcgccaattcccatgggctatggctatcacggaatttgggctgggccccaggccaagctctaaattgaattcctgccagggaatattcacaatgcagataggagtacacctaggagaggttttgtttcgtttcaaccaacaaatcgggtccctttgtaactgaaatattcttttctcgcccatcatagctacctagtttctgaaaatcactcgttctaggccaaaagagaaatctgtaatctaactaagaggcatctcactatatacactttgtcattccttgttgtgagtataggtcagagcgctaatatcacgtttcttcaagagttagataaataactcgtttaccgcccgatccccattaaccaacatgatcacttaagttgataactttatattcatgttcgtgttcgtgaaatctgatagttttgttttcctcgaaggggatgccttcatttagcaccggaggctgcctgatacatagtgtcgtaatttcgtgtaatagatggccagggatttatgtatacaatcttccacgggtaaatggtcgccaattatccataaccttgtaacccttgacacctttagtgtagtatccgggttcaactgctcgcaacgtgatgtagccgatttcttcctctgggcgcacatctgcaagctgtatccgcgtccctcttagcagtcttgctctgtctgggccatccaaactcgatccaccctcgggcaggcttacgtacggactgtcccttgtcatcgagctcgcaaatcccaatatgtccggccccttgactagaactcgtaacataagcccgagtactgcgagcaattgaagcagcattgtagctgtcagagctacacctacccaggctctactggtttcgtaaacatcgaaaacaatcgtcgcattcgctgcggttgaatttaatattgctccagaaggcgacgggtcattcttcccactttttgaaaacgaaacatcggtatggcccattggatttattgaggcactcatgtagctgtcgaaaagagtagtcagacgcctggaaaagttacccacgtcaacttcggaccacttgatgagattgtgtccggcgtaaggtgatagatgaccggcgagataactatctgttggcgatgctgagtagattgctgaagaaatatcggcgtgctgccataactcgagagccttcctcgtttcattagaggaaccgtaaatttcctccactctctctgagctttgcagaagttactggcgctttgctgagcagttcgctaatgaattgctcggggcacattgcatttctgtttcaacagtaacaactcgcatagaacagacaaaaagcgcgaaatacgcattcgagtaatccaaagtcgcaaagagaagacgggactcatcgtcctctcccagattggcccggaaggaagatccgttcaaatctggcgacattcccaatgattgtaggatagtttggtaagggctggcctcgaaagatatgccggtattggcagagcagttgaggtctatatatggcgtagttatcaaaaagttgtagaagacattcgacgcggtaacttctaaaccctgtattttggtccctagcagagaaatatattctgcttcgccatctaccagtgcatcagtatctatatcgcgaaaggaagactcccgacttgcagcagtccactgtggaacctttggcaagtcccaaagatcgcttggagaccgcctttgctttgacgaagataggagactggaagagtacaatgcaaatatgttgccctttgtggcgccctctatttctaaaagcccgaacgaggattggtgagatcccggctggagataccaaaccctcccggtgatgttggaggaacctctgctagaagagaccattctcaagccggcttgccctcccagaggtgacatcgcccatatgattaggatgattgcgccaatctgtacttgggtgcgtacaaataggagccgctcgagggcccctgcaaagctttggctgcccagcacttgttcaagaacagcaaggttgacaccatcaggccgctctacataccagcgagccagatttctgtagaatcgactggccagcgcagcaaatactataggataagccgtgggtatcagacaagctatatctagcactgcctgcccatgatttgacagtggtcggccatcaaggagcaatgctaaaatacaaagagctgcacgtcaagttcattattagcgtcagcacagaacattaggagcgtcgtcttctgtcgtgcgtaccaatgaagaaaatgggtaagagagtaagaagaacttcccatgcccattcaaggtaccaaatgcaagttctcgggtgtagcttgtgcgggctactgggccaggtatcagaggcagggtcaactaccgtttcttcggcagggattgtaacaacttgacaagactcctggtcttgatctaccttagtcccatgaacagatgtactattaactgcgtctggagtcacctcccgactaagtagtgataatatgagcatccaagcctgtgttggttcgagtgaggtagaaggtactaacgggtttaattttcgcgcctccccatcacctttgagaatattacaggaagaaggataaggaatagaacggcgccgatggccaacccaccaacatcggcgttcctcaggtttccccaactgagcatcgcactggtgttcgggtgttcccagttgtccagtttgatcaatcctttatttcccgagtcttgaaatttatacttttccaaatcgaaaatgatttttcgggatccctcatcaagcatcatggcagccaaatcttgttgtgcacagttgcatgagcaagccccagtgctgccattgcaaagttcgactgcgtaacatccaaaaaacgagggttctgtggatgtaccatggcacgtttggaatcctttaaacttgtctcttcccacgcatggtagcggaaaagatccgaactgtcttgtaacgaggtaactcattggccttaagtgatcgtcggggcagatgcctttattaccggcacatgggtcacttgcacagcatccgatgaactctctctttgctccttcacagatgtgcacatgcccgccagaagggcaactaaatccatactcgcgtatggccgtgctgtttctgtcagccatgatggtcactgtgtcctatgtcgggcagcgtaatgagcacaggtagcggtcgggtctggattgtggtgatggagaaagggaatatttctgcgcggtcttgaaggcggacggctattttaaaggcggacggcggctaactgggctgtgcagttgtctgaaattgatccagccacgtctgaatcgcggtatgatccacgttacttcggagcggtaggactgggctgcatttgaaagggggtaggatcaaatctattttgtgatgcatacatacatgcaggtaacagtggctaggtcgcaatgagggtggccccgaatcctgctaccaccatctcacaagtttcattattggacaactagatcacggattctaaatggggagaccaaaatgcagtggcgcaggccattcatctaattgtaaattcctagacctttttgaagtgtaagagttattttccagtgaccattcttggaactatttaactatattgctcattctaacattggatggatatattcacttcacagcagaaaacagctaaggggcgttaacaacgctaccgcttgcttactagaggcgaaacatattgtgaaaacaattttatcactttagcgatgtgggaactgccatgagatagccatatttagatgtacaaacgatgatcgttgctctgcctttgtgtttgaaatcatgtactcggagcaagagagagcaattatgtgtcgttctaccactattctgctggtagatcggcgatcatgagtctgtgctggctttacatagctctgtatcccgttccgccaaccacgtgatttttcatttgacacgatacctatcccatcatactctaggtcttggttggatcttggtgttcggcatttgttctacgagccctctcgacgcgggccgtgaggagctcacggtgcgcatcatcttgtgtcgtcgaatgcaagttccgggtattctctgacctggacttatcatgtctcgagaatatcccatcgggaggtgattggttgtactccgcccgcagcctttgaagcgaatctccaacactttgacgtacccctggagccctctgaaaacgccgtgcggctgatatccctatgtcgtcgacggaagaccgctgactccttagagtacctgcatcacttcccccatattcagaaggagctgtgatatctgtgtcgtagctttgggaggtacggcctgtcctgatactagcggaacttctgctcgtggcgtagctggtagtacttcttctgtttgatccactacccctcgcaatacttgccttccatagagcttcagctgtaagaggcatcgaactgtcgacatattcttggtagttcatcgcagctgcatatttgccttcgtcttcaggttccatcatttctgggtctctcgctcgaggacggagctgatgaacgatcggtctgcttcccgagtacgggtcatgtcgtgttctgatgcctcttagactatccatgtggacaagaaggctatcatcttgggtctttctagcttgataatcttgcccatacgatacgtcctcatcatgaagtagctctcctcgaggttcacgaagatttgggacagctgtttgggatccggaataataactagccggcggtgtatgaatactgtaacctcctacgctttgagattcattacgattctcgtaacgagattggtagagagactcaggtctgtcacgtctccttgatggtgagaagcccccggcgctggaatgcctttgagccaatctctgggcggtaggaggtggcccataatgaggagcaggcggtgaactactatgccccctagttctcattgggcccgtggtagtagctgtgggtacagcatcagaaggtggtatatcacgatacctcttcatttcctcaagactgtcatttcgaagatcatgagtctgccggtaatagacatctctcggagaaaggagagattccgaaggtggaccataggcagaagtatccgatgaggctgaagatggcctagaagccggaaatttaccatgccccggatatggctctgtaagatatgtttcatcaacttctgctgccatagagtgcttctggaccccaaaaacgtttccagcagcccccaaggtggcagcaacatgatgcttatccggatatggatcacctccagaatgggcctcaaactgtgagtcttcgaagtgttcttcttcaacctcttctataatgtcgtgctgaaactgtacagccttggaggttggtgtaaaggtccgacgtggctggcccggctcacccaatacgggtaagcctttaccctttggcagatctggcagtgaatgataaagttcgatgatgtcgtccgtagtagcagaagtattggtgttcattttaggggggcccggtagtgacagggcttgctcaggaaacttctgtcgaatctgctgcaataccgagacgaatgggctgatgtatatttcacctagaggattggacccaatcacatgaccatagatgtcgttcgtcatcgcatcaatgacaagcgctccggaatcaccatacgtgagacctatcagaaaatatcagcaatggcgatcggctctgggtgagatactgcagtaaggaaaaaaggatatatagggggtagtggttgccacgaaacatagtcggatcagtgaacatcgatcggatgcctagagtcatgaaggcataaaaggtcgagaatcactcacttctcttctcattcaatagaacaatccatgcgatggatgattgtctcccacttatgccacccagcatggcagtaccaggctgtagcactccatgctgtggcgattggcgacttgttagtaccaaaactgaagtctccttcaccggctgagactgggaaaccttagatagaaggatgggacttggcaagctgggtgagccatatgtattcggaacccacatatgctcattaggcttctcccatttgagcaaggcccagtccaagtcaaggtcaccagatttgtcgagatcctccgacgttatgaagatcacaggtgccttctcaaccgcctcgtcctggccttttctatgcgtagaattgatcttatcccagtagctatcaagcgcagtttgggtctcttcctcatcccagtcgtcttcctcgtcgtcttcgaggaggctttcatattcaatatcatctattaaatagtcttctgcgccagtatcggaaggatctgactcagagccataaattcggtcatcctcttttccaggttctgtcgctggctttgtgaaagaaacaacagattccgactctctatcgaaattttccgctgatgtgggtgtcccgaatgcatgtctaaacgcatgccttgacgtggttgtgtaccattcagaaccaatctgcaaagtgcaaccaagggtcgaaaactggatgtccttgatgcgaatctcaacaatggagccacatatcaaaggcctttctgctttgttagggtacgcgtcgcttcggctgtcgtgtactttagcgtagcattttccccagaagaggcttctcggtctgccctggcgccagaaatacagattaaacaacggtttatcgctcgtggtgctagctgcagtttcttgccccaaccacgttggcctccaagacgatcgacgaagacagtattgatattttagctccttattagtcaagagtcggttgagtgccttgaagtcactttttcggcaaaaggcaaggatagatggacgggcatctgctggtgaggtcccgcatagcttcagtgtatagtcaatgaaccgcatgctctctcgtagtttcgggtcctcgtacgtgtttcgtcggaacaagtttacaacctcccggaatctgtcatgatatgactcgcgtatggatgagctgctatgaggataaacaaatgttggtggtagacaaccagggatttgtactggattccggtacggatcatctcggacaccaggctggtttccttcatgcgtttctagcgaaagacactcatcgacccttacttctggcaactgccgagaggttaatttaggacttgggctagtgctaggagcggtgctaagctcagtgctgtatgaagcacccgattcacttttttggaagtctgaagacgtggacgatgatgaggcatggaatgtgtcggggtaggtgtagcgtttgtttgacgattcagcacaattccttgccatgtcttgatcttggatcctttcgaatctctcgggtgagttgattgtgagtggtcgggagttggagggctcattgtccgcgagtaagagcccttggaactgacggttcccaccagttgatagctcatgttttccaatgcccaagccacgtgaatacgaccctggcatggctggcctttttggccgtatcggaatatcatcgagcaccatactcgatcgaggagtgaggtgtgaggagcctaaactaagcaatggactgtgaatatgacgccagagtaaacgctcatgtaaacatgtaggctcacatacctagcggctggtgaaaaggcttggaggatagatggtgccgtcgctgtctcgcaccgaaacatcaccagccgaacaaatggcaggatcaaaacttgaaaatgattaaatgttgattgatcaacaatgatcgaacgatgttggtaggcgcaaaagtgagagtaataacccgctgacaaggggcgatgcaggagaggggctgtgtgcatacatgtagtagtaaccatcctacagcccgtcagcattgcatgttcagccgtgcaaggattcgggcttcacccctggcgtattgaggggaaaccgttcctgggaaatctcagagcttcagcgccaaaaatgttctcaagcccaacgcatcacaatgcgcctccctacggaagttgagcgccgtgatcttatcaaggcactcttcggggagagccttgttaaccaggccaatacgcagagattcgatgcttacttccagcattattattcggccgtttgcccagcgtccacgggagatgctgtaatagagcttgacaccccagcattgcgctcgcatggcgatatcatcaactgcgtcaatctcatcactcgcaatccacagatctcattcgatgctttcatccaaagtgcggtcgattcaaagacgggaggatcatctagccaaatggagaaggagcacatcgcgagaatcaccactgaagtggcatttgctatcaactgctcgctcaaagaatactatgcacataaccttcttgataatttctcacatcacgtcaagtgggaaggcagtgtatcatttgtcacctttattcaagacgcatttgattctgtttcgctgccctgtaacaaacctcaccaggaccggagcaagaaacaactcaaggcatggaagttatctaaacgtttcagcatcaagattaggaaaacaaacaatttgctggagcatcttatattggacccgaaaaacatgacgctcaaggtctttcaccaagtatcgtttctaagagcacatcttgagaagactaaaaacgaacccttggacctttcattcgaggagagtttgaaaaggtaacgctagaccaagatcctatatccaatagctttgctgatcatcttaggggaacattgccaccgaaattgctactagaaacactactcaccttccacgatgttctatatccagtcgccagcgttcgcgacaaaagatcccgtgcgtctttggataccatgattcagaaacacggctttgatccagagagcagatggatcgagtttgtccgagccactcctatggatatgaaatttgactactggggctctcgcctttcagtactccagggctttgtcaaaaagcctcctccaccaaacgccctggttgcttggtttgagagacacacatctgagaggaatgcactcactgttgctatcattggattgctactagcggtaatctttggcgttctgtcattcatcgtcggtctacttcaactaatcttggcgtacattgcatacaaataccctcctgcaaatgtttgaacccagtctagggcaactacccaattcaaatctcttgtctattcattttataattctctaaattactttcaatctagactttgaaaatatacgataattttcatgtcaagggagtattgttattctcctccctttgcttacccgacttgtattgctcactcagctcacgcgtgggtcaaagtgaaacccacacatgttctgtgtcgagccgattctgtcgagcacatatcagagccaagccgctttcttccaggttcacgcagcatttgagccaacgatatgcactctaccaaacggatgacgcagggatggtcgtgtcccctgttgctggcccactccttgtagaagaggtaccaacagacagttgcagaacttccgttgctgccttgccagaggacttttgcgccttttaattacattacaagtctccccccccctgcattgtagaaatcttggcccgtgggtaacggtaaataggcgtatgtaaggtggtgcggctaagcaaccaacagaccagagtccaatcttgagatcatccgatgctcccgtcacgtttgctccaattttgcttcgaggttagatttcccacatcaagtcagttctcgaatctctcacagaaagcctcgaaaccgttttgaaacatctaaggcttcaggttgacaagtaagtcgaaaatggcatctctgggctcacttccaccactatctcgagttgcctcgagacccaaacatgaatcaaaatcataaccacacaacgccgaatcagtctagatgattgatgccgaaaatatatcctagagaagagaacattgaaagcagcaatacccaaatcatgagttggtttagcatatgaattaatcatatcttactttcctttcatattgagctacgttaaatgtgagagtctctgctatctgtaccagatttaatgataatttaagatcacaacaaaattcctcttagagccatagtccgaaatatttcccaactgatctagctatattccgcctagagcatggaacgctttctcacaatcaccctcataccagattagcactcactacacatatgccctccataccatcccggaactctgagtctaaggaacactacgcaaagaagacgagcgccccgggagctctactctcctagtaggattccgtttcaacgagcccgggacagacgtgatggctggtgttttctccggcctcgcctccgagtcgggggtttctggcatcgcagagccgggatgattcttgtatctgttccttcgcctcatcaaaaaccagacaagtagaataataagtgtgatcccagcaagaccgccaacaataggccctgcaatccatgcaaggtctggctgggtcactgacggcaagcttgaacttgaagcggaagctgaagcggacgctgacgctgacgctaacgctctgctagattcttgcacggtagagcttgtaacggttggtacggtagttgttctataatggtacaatgttcgcgtgcctgtgacacagccgatcatggtgcgggcggctgtatctgctgggtcattgaagaaccaatcagtccggcaagtagcggttgtagggctaagggcaaatcagttagactacagcggatatcaaacagagttatattcaggctggcagaggagtcataccatatggctgttgtggtcgggaatatcaagacggacccatctcgacaccgagtaggcagagctggctggtccgtgtcgatgcaagccgcccaataccttgatgaggtgaagattcccttctcacaaatagcaacctcatctggtacacatggttagcgtccaggaagatgaaaagattatgatagtcgagagagtagcatttcaggtgctgcttacagcctgctccttgccgaatccacccaatgaaatcgggagcttgtgttatcatggagtcgttgggctcgctgctcacatggaatacaaaactaagaagcaacagacaaagggagaactccatattggctaatattcagctagatgattatttgatagctatggagtgtagaaagcaatgaacgaggggccacaggggagactggcaaaggttttgagggacggatatgcattttcttgggccaactaaaggaaatacagactcacatgagcaatagcttagctgcttttgcgtaacctttatgattggagaatcacaccaacggcaccaggtggcaaacgctgaattggcttggcaggcagacacgatatgcaccccaacaaatgtgccgaatcatcggggccatcgaggggagaggcggcccaggatccgcgctatttgcaactcgcatgcatccccggcgaattagatcgtcgagcttcagccattaggcttttgcccagcatttacggtcagtgcacagctcagctctggtctcagaatgtgacgaggagaccacctaaacgttgttaggttttttcatgcccagtggctcctcctctccacgcctattgacctcgaacaaagaagccttggtatcttttcagcgggctaggctcattcagccaccagccacctactttcagctcgcgtggggtccccaactctttgacttgatagactgcaggctcgtttatggaggacgggcatgcaggctcaattgtacaataaatatccctggtcatggctaactgtgttctagagcgctatgatatcccgtgggggtgatttcatcgtataccgtatggagagttcgactgcttggatattaggtgtatgcggggaagccattccaagcctagatctacatcacacagtctcagaatagctttggcatctatgaacaagtgttgttatcacggtctgactatgaattacttttttagttgccgttgtctcctctaatccactacattaagccagatacaagaacagacgacttgtatattcgtcacatcattcactctactatgtcttcttggtcaattacaatgagggtgtaatgaagagaaatcgagttaatttataaaaaatacactatacaacgcattctaagctcttccgtcaatcagcgtcggtgcaataacaagtatgacctgctgctcgccacgagttttgcaatttgtatccaaccttcactaagactatcgttgtttgagttccaacctccataactgtttttttttttccagtcatcccctggtcaggttctttcccatattctgacgactcactccgattgacggtcagaatcagtcgccacctctatggcgtccttgaggtgtctaaattccagcttcgacttctcgaagagcgccatctgccgggcagttgtaactgcgtgatgtatctgctttccgttaagttggaagcacgacaaagcagcaaggtgcgattgaattccttgtgcaacggaacttgcactttctgcccgcagttggtcgaggcattgcttccatacgcttcgtctagcgggtttgtccaatggtgggaaagacacagtgacttggcagcgggacgtatatttctcgttgatgcgttgggcatcgctggatgtcaatatgatgatgccgtcgtgattttctatacaatcaaaaaacgctaggcgcaatttagtatcagctctgcgtgtgttggggatgtgctgatgagagctcaagtataaagtaaaaaaaaaaaaaggaatggaagacgccagatcagacatctcaacacgacgaattatacaggggaagtatctcttgcttacctgacgggggacgattgtctttgagatccgatccgggtcccttttcaataaatatatcgaggccgtcaaataccacaactatgatgatttagtgttcagtgagtcatcaaggtctcatggtagattgtccacgcactggatttccatttttgggccaaacgaagagagcggacaatagcttcgcccgttgcctcgtaagtcagccccatcagtccgcaagtgacccggaaaattggcatctcggcaatttctgctaggctaattcgatgttaaggtaagccttttgtcctcgccaatgttttgacttcctcacctttctgtgcgagaaacagtttagctaaataatcgagatcaagagaggaagcatggacatgaagacataccagcagcaaaactctttcctgttccaggaccgccgtggaaatgcataatcaagggccttccgtttcgtgagacgagaaaattggctctgtcttgcggggtttcggcataaccaggcggcttggctgccggtttcttcgtcatcacgagcgccttgagcatggtttttgtccgttgtggaagtataagtcgattgaatgcatccttgttccaggtaaccggtcggatctggtccaacgatagatacactgcggaggttagcgcaccgagcgagattcagtagactcctttgatgccaagtcactcactccacttcaactccttcaggttgtacgcttggataccctgtgggagtagcatttgctgaatcgcggttggctcaatggaggccggaagatcgtctccccatttatcgtactccatcttgcgaggcacttttgggtttttggcgtactcatcgcgaccctcaccttcgagccacatgtcgtagtcaatcatccatcgggagtctgctgtctacataaagtaagtcatgactttctaaggtgctgaacccaagctcgactcacataatatgtctccctgttgtagtcccacccttcataggcatggaatccctggtccttcaacttccagaatttggcgccattctgtagcagctgttgggttaaatcgtctgagccatatccaagtgggtacattccaaggtcttcgattttcatgcttgccctgctcgcgatcgtcgggttcttcaacctgagcatcgtatacatacgaaacaggtattggccgttgaatccccagttccaggctgacagcatcaccccttccttatccacaccaacacgatccactacatacccaagctttcgatgacctttttcaactatgcaaagaccgtcgatagggaagagccagcacacagtcttggcggataccaaattctttgagaacaagttgtcacattcagcgtacatggagatagggccactttgtaaccactgagctagaagcttgatcggactgccatccggagccccagccgccttggagtagatttctctcctgtgatgatagaagaaatagtgagggtatgatgcaggtatcatgtgcaaattatctctgtggaaattgtctcgctctgatttcgcgtgtttatcgtcaggaaggtcgatggtgaacttggagagccgcttgatgatagaaaggaggtctttattgatgatggaaactacctcatcggtgtgtgtcgggctcattttttgagtcatcgttgcaaacccgctgccggagcattgaaatgcgcgatacacggcaaatggcgggttttcacgctgcttcaggaactggtccacatctgaaaccgctttattgcccgtgaggtgacctcgattgtactcgggcgaatcaagatacaatcgttggtggcacttgggatccaagtcatcgcaagtaactcggtgaaacatgatcggctttttataggacgcatcaatgggatgcgtaaacgcggttggtagccctggctgggtcgcctggttggcgggtttcttgcctttggactgagtgccctgagtgactcctggtgatgggcggcgtgctttctttgggggtttctgtccgaaacattagctgagacggcagggtctttcaaatgcaataacttaccatcgaggagggagaagcggcatccaggcctgctgtaaatccattttcctcaggtgatgcgcctgctctctcgatagcttcgtatatcttttgctggagaagttctacctggtcatggtatttgactgggtcggcaaggtcgcagctagaagtggcgagacctgccgccgagcctatcgcttggcctgcgggctcatcagcttcgtcgtcgagggggtctgcatagctctctataaactgcctcaattctgccagattctttcgttgcagcaccatctgttcatccaagcttgctacaatggccgcgtcatctggattcagaggtgcaccatcctcctcaccttccgaggcacggccttcgtctggggactgggaggcgggagccatggcggtcaaattcagtgtctggtccctcactacttcagcggtctggctggctgccagtcgttcgaaggcgtaacgagcagaacgaggtctcctgtgatatggaactgggagaaaggatatgaaatggcgagacgagggtcaaggggcgcagtccaccaagagtaagggagtaagggcaggagagaccctcgtgaaaactcttgagcacgaaatggatgcgaggaggaaaaacgcgtcgactgatgtggcacctgtatgcaaccttgcgtcacgggtttgattggacgccactggcgagctgaatgcacgcaggtgaacaaccgcgattgagctgaatgacggtgtagctctgtcagaccaagctgcttggccggttgtgacggtcgcattaagattttgcttgcattccaatcccaacaagcggttgcgtggcaaccttttcgggtgtttatgtctcaggagcaacgcttcgattgtttccaggaagctttttcttttttttcttttttggaaaaaaataacaagatgtgcttgcggaaagcacgacgggtgtctatttaccctatatccattttcagtcagacaactacctttgattctgacagaaatacattacagccattgaatataagcagaaatttctcatacatcaacaatcccgagacacgtctagactacagagtattcattcaggtagcatgagaagtcacatttaaacatggagtttccagcgcgtaattcagctcttcggagcgcgatcatgcacgcgtcggtagaacgaaagacctttttttcagcacgccaagatccattccgtagcccagtctttgtcgcctttgtgagaacctaccacccatatttggtcgccaccgtgactgtaatacggatggatgagccagctatcgatgagctgccccagtggccgcctcactcaacgcattgcaaaccgacctaaccagcacatgagcgacgatccctgtctcttcttgcttgaaaaacaaagcaagtactatagcaaggcgggccctagataattgattggcctcctttgcgttgtgcttgacatagctttaaccgccacagtctatttcaggcaatctggcgctgatctcgtgatatgtcgcataaggaggatcctttgttgatggcccgaaatgcaattatggatacaggagactctagtgcttacttctggagagaataattattggtgcccgcttcttgagggcatttgcacaatcttgcggaatacatggtgggatatgtgaacctaacgctcaaaatagatgtgctatgatatgtcggctatagactgattcgaatctccaaatcagaacgatcccctgttgtctctatgatcagtgacgaaaagtttcgtaccagttcactcccatactatctctctttcaattcatctcggcaagtcaatcaccaacacactgatttctgccttccttgtacttcccggcgcataagaagcaccccatcaatagaaccagaaccccaatactgtgatgacagaaagttaagagaagcaattagttgaaagtgacgtcgcgaagctcgaagtatttgaactcgatcaaccttgagaagaccttgccctccaagaagcacagccgactaaatttagcttctacctcagttcaactcagtcttggctcagtctgcacgactattgcttggttccagccctagaaaaacaaaaaattgcagtgagattgcgttttaatgttgtcaaaactcaggttgagtatttttggcatacctacacgaggctctgttggagctcagtacccagcgcgaaatattttccagtgtgcccgcagctgctctttatacagctaatgtctctattcattaagtgaaggattgtaaatgaacaagagagcgaccaaaagcacacagcagtaaatatctgtttgtcttcatcagccaactactcacgaggaagtacctctctagctccatcaaattctcctcttcgggcgttagttctatttcaaatgatcctatgaattaagagtgaccccatcctagctaggcatgcttgttgttgcctagctagtgactcagctccgttctcccatttcatctcagctatccacaagctgcctagacgctagctatattgcctttaacttccttccccccatccacaataaaaggttgtgcacttcagatcaaggcaaagaatgatacaatcccaacgcgatttttcaaacacgctgaagcaaaatatatatcctactctcgcaggcaaccatggcgaaccaggatggtgtctatggcacgttcaccgtttcatcaggatgtgtgtgcttcggatccctccataatatctggggcggatctcttgccccagtccaacccttccgtcaggtcaaacctcagccatcgggtacagtttcggcccacgaattcaagcacaacatcgcagcagtgaatgggacctggaatgttttccagcttaaagatctccgatcaggacaagcttctggctggttcgcatgccatgtcgatgtcgatccagatcgcgaaattgagaaaatcctcaccatctcggggtcaccatacgaagacaaccacggcagcactatgaataatgacactacgttcgcgaatggtgtctttgtcatcaaccggtatgactggggttactacgcccgtgagttccttgaggagattggcgagggagtttcagaaggcgatgccgatatgctcgcggactctaattcagcaggccttgcagactacgcacaggcgcaggcgaaagtccaggaatggcaacggtataagcctagtaagcgacgcatttcggatggtggtgtctggatgtattcccctgatgcagagtacatgtttggccgctttggtttcaatgaagctcgaactgaggcgctatcattcttattcttttccacaaatactgaattttctcacaccgttataacaggccgcggcgagaccctgcgtccagaaaataacctggatacttgagcgacagggttccattagaggatctccatgagtataaactgaaggtttcctgctagagtccttccaaactcatgtataatggaatatatgctcctggtcgcactcttgaactcgaaaacgatcatcctcactttggcaactttcctaataatgcatatctacctaaatcaactctcaaatcttttgcgtataggctgtctttcttgtatttaactaggatcgccgcccatctgactggatgcccccccggatgccatgtggttaccgccatagagcttggattttgttttcctcaaggttggcagggctttgagaagaaacttctccacgggattcgtaagaatcccataacctgtttctcacattatcacaagcatcctaagctcccctcgtccggccgtgcctggggttgtagcaattaaacctaggctagccattaatatttaataatttcaggtggcagccgcatactcccgtttaaccgccatatgggtaaacggcggcggaaggctgatccgtcggcaactaggcaaatttcgccgtttttgcatgggattttcctttgggagctggagcttgatgttcctgattgctgcttttggcaaggtgggagaagagccggcctaccagccggatcagcagtttgatctcaggatcaccaacaaggtttccataggccggggggatctcagtgctacactctaatttgagcatgaattccagcgaagggctcgtcaccccatcacagcccctctcttcaggtgccggacaagccacctgacagttaacccatcaatcgccccatctgctagcccacttgttttctgatttggacgaaagttcggatgaactgaatagccgtcacggataattggaaacgcgtcaatgtatcgtgggaagttccgtgatagttgtgaataatctatcctatatattgtcccgagggctgtcaccaagtctcatttctggaggcttgcgtcgacagcacgaacagagggcttaattcaagtcagcatcatgcgttcagacatagtccttgccatatttgtggcctcaaacgctgtctccgcacagcttcataccttggctgttcgggctggactgaaatactttggtactgccgtggatgagggcaagcagagtgactcccaatacgtcagcctcctttccaccacgactgagttcggacaagtcgttccagaaaacggtcaaaaatgggcgtacacggaaccatctcaaaactcgttttcttatacccagggtgacattgtgcgtttggattaagcggtacatgtgcgaagccattctaatagcaaatctcctaggttcccaacattgcttcaaagaacggccaaatcctacgctgccacactcttacatggtaagtattcaattagttcgttgattgaacaggagctcaccagaataccttcaggcactcacagctgcccaactgggtctcgagcggctcttggacaaaagctactctcactgctgtcatccaaactcacatctctaatgtgatgaagcactatctaggccagtgctaccattgggacgttgtgaacgaggctgtcgatgacagcgcagtataccgaaatagcgtcttctatactgtgctcggcaccgatttcatccccatttcttttactgctgcccgggctgctgacccgaacgcaaagctgtgagtacaacattattacaaagaaaaatattcccaagcagtacggttctaatacgggatcccaaagattttacaatgactacaatctggagtacaacggtgccaagacagacaaaaccattgaaattgtcaacctcatcaaggccgccggtgctcccatcgacggagtaggattccaaggtcatctgattgtgggctctaccccatctcgtagcagcctgtccacggctctccgtcgcttcacagccctgggtgtcgaggtggcttacacagaactggatatccgacactccagtctgccagcctcttcatccgctctcgtcacccaaggaaacgactatgccaacgtcgtcggctcttgtctcgacgtgactggctgcgtcggagtcacagtttggggcttcacagacaaatacagctggatcccctcgaccttcaatggggccggtgatgctttaatctacgacgccaacttcaataagaagcccgcatggacttccgtctcatcggtcctcgccgccaaggctactggaggcacctccactacttctaccggtgtgacggtcacggttacttctacctcagcgacggccacagctacaaacactcccgggcaggttcactggggtcagtgtggtgggcaaggatggactggcccaactgtctgtcagagcccatacacctgcacttacgttaaccagtggtattcgcagtgtttgtaaaattatgaagagttcgtgatacttcacagatcaaggatagctaggatttcttcttgtgagattgaacttagtacactttctgaaattcaccaagcgcttgctcttccttgtaatgttgatagtaccttcttactgcgtattcgtttatgaaagctgcacacgaagcccagccaacacaacaggtgcccgacactccgagaagcttggtcgattataaagggaagcttttcgcatcaccgctgaagatttcttctagtacattctataaaccattcgaaacattccaagaacctcgcggcacttgcaacactgccaccaatatccagttaagatggcagcttcaaactatcccaccacccactcagtgctcctctgaagcgtttgccgaaagctgtggcgcaaattccgcgtctatgctgatattactgaacccgttatggtaactattagggaagtgggtggaattccaatatcgagttcatgctgtacatcgctgaggtcaagaaccgtgcctcgcacggcaagagggagaaattcgctgcacagttcttcaatacagaggatgcaatggaactgttgactttccaaagtgatggggagtttgtgggccgttcaattaatctcgtggagagtcagagcaagaaggcctagaacccacatcttttcgacaccggaattgacatgttgatcaagagtcagatgtttgataacttgcatttacttttcgtttcgagattcttcaactcccagagtagttattcctgaactgcttaattgcccgcagtacgctatcggctcagctatgctcagagttgctcagttactcccaactggaaaacatgtggtcaagaaggttgaagagtgtatagtccaatcacaatatgatctgtagctagacagatcttccccgaacagattcccacatcgctcattatagatagactgtccaataaccacctaagggtcccaattcattccccagatcagtgaccagattatttattgtttagttcataaacttaggtgttgcatgcccccacattgccatcgtttcaatcactttctgggtacctgtcgatctttttgacccgatgattcgggtcgccataattacccgttatctcaacaccccttctgcagtcatcccatgtgtaatccacaaagacgggcaccctctgttttaaacggtggaatctcagttcataccagtaatcttttgtggtgtcctcctaatcatctattccttttccgcctcgaatggtggcacttcgtgaagcaaagcaagcaccatgaacggtgaaggagttaaccctttactgagctagggttgatttaaccagatgtttatttaattagttcgtattacgatgagcgtttccacatgaaacgtcatcgagagcccagagccgcaaaatcaacgtttcaagccctacgttgtgtatgaaatgatttcttcggcaactacctattcactattacactcatcttatgagaaaaatctacgtttctcagtgaagatgtatcaagatccatataatatcgttaaattatcatgccagagtcagtttcaccggttgatggaggcttcgtcccctatcaatagtgttgggagctgaagcgctcacgggcccaaatttgtccgacaatgacgacacccaattcttccgttcaaaactccacaacatcttgtatagctttacgccaagcataaaaacaaccttgccaagcttttgggagtttcctttgcatatgcagctcaagccgaaaacctatgaggacagacaagtgatccctctctcaagataggagaagaattgaatgagattcatgttttgaaaggcttaaaacgcgattgaaatccactatagtgtgtatttatacttatgcagatgcagatgcatgaggtcattctacagggtttccagactcattccagcctgagatgggatgtatcatttccctttgaaccatatgcaagtcaaactttatcacaagctccaaacgttgatctcattgagaatagcctttgaagtccttgaaacatgagtatttacgagaaaggattccttcgaatgatgaaagggcccagtgggtcagcgacgtgcgttatgaatcttcatactcgatggagaaagaaaaacaggccagaatagagcaacataattaaaaagaatgttccgtggtttctcttgttaattatacatacagcttactcagttgcaaaaatcgatgcctccagaatgaggatagtgggcaagtcgcctttgcagggcgcccggccacaatttcaggggagatgaaactacatagtcatccctcttcaggtcacgtcctctacgtaactccagagatatctttaatggattataagcaagtattctatggcttctatgttgtgatgataaatgcacaggatatgggtgagcacatgccagcgcgggcaaagcctgagcgaggtcggtaaagaccaggggaattacttttccagaacggtccagtgcaggggaccaaggacaggccgtgtaattgatcaacatcagccattgacgtcgacaaatttcagtcccgtctagatccaaacactggccctcggagcaaatctccattgggaaaaggacgatatggctacttccgccccctcccatccgagctagccgtaccccaatgatcaggggagagattaaaggcttgaatatatacatttgctgcctttccattctcctttcacaagcaagcaatttacggtgaaacagggccagtctttgatgacacgccacggggatcaaggacccaagacgtcgcaaggattggtggaaaaagccgtcttctccgttcccctcgatgtacccacaccacaccgtctgtaactaaccaccctccgtctggccacttcatctccgattcttccaatttaccatcccacccttctaatttattctttaataagcgggggcgaaaaagaacaaagaggcgacgatcacccaaaataaggggtcccgacgggtactacataccctggaggtcatggcgtacacagcccctgaaactggggtgagaagatgggtagcactgtatggaagattggattctaatcggaaagcccgtgttgttggaaatctcatgcatcggatggatgagcatgcagacagatggttcgtgagctcgcttatgcagtggagcgagcaggaagctggggaaacccaaccagttgctctcaggcagagaaaaggcaacatgacactggctcgggtgactatttcctggccggagccttcgagcaggaaatcgtactatcaccgatggacatgccagatacagttctgctctttatggagagccctgttccgtctgcgttgttccgtctgcggagggccctccttcgaacctcgcctcaccgttccctccagaacagttatacatgatgggcaccatccagcaagggaattttaactttgggacgagggtcgcatggcatgaagtgacgacgtatatcctgtccgtcgggccgagcttatttgaacgcaacagtcacaaggcattgacttctcaagatccacaccgattatctacgtccactcctggtcgcacactcgctcaagcacgtttagtagggttatggccatagtatagagtgcaaagaaatcactatagccagcccctcctccccgcgtcgttgcaacctgccctaccatggagatgtagccctcccggtggagaatgcggtcggtcagtaagtgagctgtccttgatttagcacaggcgtcgtccgtccccagaatcgaggtgcagatggagctaggctggttcgtgatgggaatcgtattagccggactgggtcactttccatccacgagccagggtgtgtggagattacgatttccgaatgtgtggtgtgtgcctgcaacacccgcatgatggccttgccccgcggcttctttcgtggacgggcgtgcagcgacagcctggtccaaaaagcataggtcttctcgcgagtcgacaactcgtacaggtcgatctggtcacatggacgaaagtcaaacgacggtctgcctttttgctgcctgctagctatattggggtacaatctgccctggaaagatgacatgcagacccacaggtgacaaccgctgtcatgtcgtcacttgaccggcagatggattagggacttggcgcccatcgaaagattcggatgcgggaaagaggaggttaagaggggcctaagagcagaaatcggaactagctgctcggtcgaagaggtcgagcaggaaggaggttgaagagcggtgatgggggaactggactgaacgatgctaccgcccaaccccaacttccccgccctctacctctctcgccttcgtcctggtgcatatttcttgcttccctcgatgagacacgggctggcgggaaatccaccttcaactgacggcagcccgctcgtctgggcgatggaccagatccagccaaggaaggcatcctcgaccgtcttagcacaccaccactcgcacccggccccatcttaccccggatttgcgtctacaggtggccaaaatctcatgttggcctgccttggatcttcgctgccatgcccacaatcggaggggaggtgataggtgccatccaagctttgggtgtcgtaagccagtcagaattcgattcggaatcacaggcagagaccagtacctgcaggggacggttgtagacgagccaactgcctcggtcccctgatctagtatccccggttctcgccaccacgccgacgacgaggtatgttctgcaggcgaaggaagagtcgagaaggatggaacgtcgttcggtttctggagttgatcgtgtcagcggcggactgtgattggcgcggctatagaggtgcatgggccctgtaactaattcactagggcgccccaaagcccccatatcaggtctgcactaaccactgtagcgtaatagcttgtgggtgcggagggttagaccgtccgagaggtaaacggttagcagcagtttagggccccgaacttttgctcaggttcttcggaggggggttgcattcattgattgattaagctgtttgtttttgcggggtttggcaggggccgctgaggtgaggcattgagatccatgttgcatcttgcgcgtgcgctggtcacttcgctgctctgctgcagtagctgcatgcttgggccaggatagaatggttagaatatgcctgagagaacgtatatctctgtttgtgttgcattggccgaagcactaggtggaaccttgatgcaagtagcaaggccctccgtttggcgtagcagtgtggttaggtaataacggcgggctgcttgacaccttggggatagccctcggtcggtgtccgatgcgggcgtgggacggccgcaccttgggatagccctacagtgagcggcgacggcagtgttgaattccctgtcgtattccagctgagccgtcgcagtcagtcaattagatagcaacgagatctgcctccccagctgcccgcgactagtgcagttggcccgaccgtggggcgatatggcacggatgtcggctgtctgctggtcttttctgcttcgtattaacttaccccataagtcagtaatgggcatcataatatggggtggagctttcagggtcacgatggtcaaactgctctcacggagtaagacggaggagtcgagtcgaaactgtgaagcccgcagccctcgaccccttctcatttctcgctgccgcccaccgtccgacctccctcaggtcacgatcctctgtggggagggctgattgcagtgacacgtagaaagcggcacctcttggctttcccaactgcacgacgagacaaaacggaaatgaggtgaagtaatgtgaggccgttggtaaggtgaggccagtaacggagagcgatgggactttgaaccgtggcaccaccgttagcaggattgcaccaataggaaggcgcaatgcagcccccgaccggcgggaccgtgttccttgtttgatatcgatgtgatgtgatattctcctcaatcaaccctctcggacgcccagcagcaacaatctgcagtctcctctgctcgtcgtccccattacagagaacgggccgactcgagtcgcccgtcgagggctgcatctgatgctgccaaccccatcagccagcctgatttggttctcccacaagccccctctgtcgccccccctcctcctccccacacgctggaggcctggtgctagcgcttgggcttgctgggctccttccatgcgttagcgtgccctccccgtacttcgtcccttgtgactgatcaaatgggccccccagcggccagccccatctcatcaccgtcttttacgcctgatcgcccctgtaacctcctgctgccgaccaacccaacccaaccctccttctcagtccgcgttcgatcttcagaattctgtttgttcctctcatcgttcaaccacatctctgaatctctcaagttggcccaagctcaccctccatccatccatcctacccagacagagactaaggtaccgagatatctcgctgagcacacttgccacccctctggaaacctccattcgatccacccctccccccagcgtgccgccatcaactcgaaccccaaccaacccccggacaaccttattcgttctctcaattcttctctattcatggcgcccgtctccctctcgtctcccctccttcacgcagtcttcacccgtgcccgcttttcggtctccgcctgtggccgcgatcagtttcctacccttatttggattggactgtagctcgcccatataacttttggcaccgccagatcaagcacacctcgtcaaccgattgattccccttcttctgccagcacaccaacggcctgcttcccataaactaacccccgtcacattgttccagttgggccttgttctgttatcttcgcttatgcgaacggccctcttgcagctcctcgccctctcttcgctttcccctctgtgccattgaggctgaattgtcttcaccccagtgggatttttctctttcctcggactttgatttacgccgaggcagcttctagttcagcgcaatccaggatgttgctgtacacgagactcgcacctccaaaggtccccaagacacgatcacgagcaggtaagacaaaaaaaaaaaaaaaaaaaaagaccgagccttttttttctctttagaaattacactcacagcaaaatactccaattgccaatgcctttatacatcccctgcctagaataaacaagctaaccaaacgctctcattctcctctccacaggatgtaattattggtaagtattcctccttcagacctctcccgcacggtcgcacagcagagctaacaagtgcttctctcccgcagtaaagaaaaagtactgttgattccatccccaaacacaatcgcttccagtgccgaggttatccttccatgtcccaaatctcacatactaacccgcaatatagaagaagaaatgcgacgaagtccgccccaactgtgcgcgatgcctcgagcgacgacaggaatgtgtctacgaacctgtcaagccccgacaacggcgcaagcgcgatagtctttcgctcgataccaccaaggcaaatgctgcacgaccggaccgggccctgcagatccacacacccctctctgctgtctcgatccaacagtgggagagccagcagagctggagggacaggattgatgggcaaggcgacgacagtagcagtgacgggagccgaaggaccggcgggatcgaggcgaccgagtcggtcgtactggacgaccagttaggacaggtgccaatgtcagcgaacaccgcccatagcgatttagagacgtatttcacctcatggacaccggcagataccacagctgtcttctctcccatcacgacgaccacatttgaccttgcgagcctcgatgggtgttcagctcctcatgacaacgacagagatgtggaagaagtcattcgccgggactcggccgcagtcgcaaccgccctcacccttacccacaaccaccaccatccccaagaaccaacaccgttcctcgaattctgttcgccctcctttgctgaattctccggtcggaagaaccgtcgcttccttgtcgatcacttctgcaacgttctctcccatctcatcgtctttcgagaagaaaacggaaaccccttccaacagcttgtccttccgctttgccaccgaagtcccgccgtcatggatgccgtgtatgcgctggcaagcgctcatctcgagtttcgtggtgtagatccaggcgagaaaagtgacattttccatggcaaggcaattcaagagctggccgggctcattgagcgcggaagcaaacaaaatcacgagaaccggaatgaactcctggctgcaatcatgctgatcgtctattatgaagtggtatgtttagcattcgctgtctttgagagctctcgctctcccccaaacatttacgataatgagctaacgtcggttatctttacagttggtccaacgcgggcggtcaaatattgttgatggtcacctaaagggcgccatgaccctgatcaacaactccgaggcgagcagcgacccaacaagtgtctttctggaacgagtacgtagctacacgaaaccccttgcttcctatactactttgctgactagttgactcaggccttcggtttctacgacgtcattgctgcattgtcgttcggcaccgcaccgctctcccctgcccctggccgaggacagctctctccactcccagccctcgacccacgaggtgcaccctcagcctcctccagcgtagacaccctccttggcatggctacgaccctctggcccatcatccaccgcctctccaccctcgtcagcctcaaggccgagctcgagactgccaccgctcagggccaagtttccaaagttgccgtcctccgcaccgagcttgagacgaccaccgccgccatccaagtcgcgcttacccagtggcagcccattctcccagccgaggacgtctcgtcatcctcggagccagagacccttaaagaacgctcacgcctgcgcagcatcgtcaacaatgcgcacgcctaccgccactcggcgtttgtgtacctttaccgcacgatccgcaagtacccgcggtcgcatgcgcttgtgcagcagcatactcgcctgagcctgcagcactgcgtgggaacggtgagcaatgaggggcccatgagtgcgctgctatggccgctgttcgtcgcggcctgtgaggcaacggacgagggggacagggacctggcgaggcagtcgtttgtggccatcgacaggcggcaggggatggcgaacatcgaccgcgcgtggacggttgtgcaggaggtgtggaggcgggcagatgatgaggagaaggaggaggaggccatgatggcggcgatgatgttgatgcgcgatgtggcgggtgatatggcctctaggaagccgggagaaggctcagatggggcgatgctgatggcggagaggaacggcatgatgatgagaggcgctggtgttgacttatggcgcagagtcagtcgagacatgggactgacgattgtttttggataaaaggagagggcttcttctgataatggtttcggagcatagcggttctggtgacggggtgggttgggatacaaggacggtctatcacggaaaatcgagacagaccatggagctattcggttattttgggcagcatcttagtgctggtatacagcgaagatccggatgtaggaggtgtaagtggaaacagtaaaattgcatctctggttttggaattggaatagggcgcgtcaattaatacccaacagatattgaaaatatagcacattgtttacaacctagccatccctcagcagcatcgcctcaattcgctttcatccttggtcattccgtttcctgagatgtctcgagcaaaagatgatctgacaatcatgtcctaggcgcctgaaccgcctcttcgctgttggggaccgaaacctgatactccaacggcaacttgacagccttgccgggctccagatacaccagccactgcacctgtccccccttccttagatgcgccgacgcccgcccccacgccttatcctcctccttgaagctcctaccgggcacccccgtcggcttgctctcaccgtccatgaccaggccctcgggctgcagcaggtcgacgcgcagccgctcgtcctcggcgacggggatctggtcgagcacgaacagcttggtggcctgcgcggtccacgtgcgcttgttctcgagccgcacgcaccgctcgtacaccctcacgtcgtctttggcgaagaagccgcgcgtggccttgtgcacctcggggggcgggtaggcgacggtgatggccgggtcgacgccgaggctgaggtttaggtgctcgccgacgctgcagcggcccaggggcacgcggccgaggaagctgccgtcgagggagacgccggcgagaccccgggtgaggttgatcttgctgtcgttctggagcttggcgctcaggtaggcggccgggcggtatttggccacgatggtgtggcggaaggggacgtttgggaaggcgatgcgggcgacgcgctggctggtgggggtggacctgggcgcgagggtcttgaggcccgggaggtcgtaggttgtggtgaagccggtctggtcgatgagggattcttcgaagctgaggcgggagtcctcgcggccgacggtgcctgggtcagagagggctgcgtcgtcgaagggtggtggttgctcgactggcgcgggagggaaggcttgtggttgcgggtttgggggggtgtttgagaagttgatgactccctctcctggttgcgttgcctgcatttgtgcttgcatctgccggaatccttgttgttgctgttgctgtgcttgttgttgctgcatcgcttgcatctgagcttgggcttgcgagccttgcatttgctgcaactggactgggactggtcctgtttgtggcatgcgtgctgtctgctcctgtctcgccatcgtcatgcgcttcttattctgctgctccaacaacataagctgcatttgataatcttgcatttgctggttagacatgcccgcatgtggtccagctcctgaagctgccgggacaggtggtgggtgagtgttagatgaggggttgtcgatgccaaacattgcaatccttggcttcatgtctgacctagggtgttgcgactcccaaaatcttgagcgcaactcgacttcctcgcggctcttgacgagaggatcgggtccgtagccatcgcccttgggcttgagtatgatgttccagggctcaagagtaggagcagcatccacaaggcctgagaatgctgcttgcgatgtagagagggtaaccttgcacctctcccaggtctcagaggtggtgttggtgatttgcgcatcaaagcagaggatgccggtgcagttcgtagtatcgagctggatatcgtagctcggctgccaacaggctgccccggtaatatacgagaggatcaagtcgcagctctgcagcatcacatcctctggggccaccgactcacccttttggacgttctggggcatctcccggtccttttcgcccatggccacgtcgacactggatggcgcaggtgtggcgatgccaacctcaagcttgatgtgcacggcgtagcagtacttgggccagaagctctccctctcggctcggatgcggttcttctccttgacacgctcctgctccctcaactccttgttgcgccgctcgacactcttgcgcttccggaccttggctgtctcgcggttggcgcgggtcttctctcgctgatgccgtttgatcagccgagcgcgtatggcctgcgccttctgcagctctggctcgagcttgctcttgagctcttgggcttcgaggcactcttgatgggctttgatgcgctcgtccttgtaggtggccattgccttctcaatatcaatgttgtgcttgggattgagcgagttgtagtatccattgagatacctctttcggagctcagtggacttgacgacctcattggctatctcgacctggtcgttgagctctgtcacgcgtgctttggctgcgatgagctctgggctctcgctgacctcgacgtcttcgacgtccgactcctcgtccgacttttcctcgtcgtcagagtcagggtagacgtcggcaaacagctcatgattgggcacgggctcgatgctgatgtcgacgatggtggctgcgccgttgccctcgaccttgatcgagtgctcgtcgacggtaggtgtgagacccaggatggtgatctcattggtgccagggcgcagtggcacatctcgtacatcacgggagacctgggcctttgtagggaacagagtcaccgacctagtgctcaagtcacggatgttgtactcgactctggagatggagtccatggtgactggttcgacaaggccagcaggtgatgcaccaagggtttcaacaacttcaagtcacaaagaacagatgttgtatgtgtggatgagagtgactgaaccaaatgcttcgatgagtcaaggtactggagagaagagatgaaggagatggacagaacgccctcgatgggatggagagggggcatgccgcccatttaaacaaaaccatctcgcccaaaatcaattggcgacaaggcgctccaggcatctggtctggtgctcggtgaatgccttgcggcccgtggcagattgcctgagaaaggcgacaagcatcgtcagacaaaccaattgggcgagccgattccgaatgtgtttgaccggtttggttaccctgtaccatctagcagcgacaccaatcctcattaggtaatttttcaatcatcaacccctgcaacgaactaactaggtatgggcgtgtgggtctgagtgggtctgatgcctctaattgttctgactctgttcgacgatgcgatgaaacaaagtagggattttctgacaatctgtttgggatagatgctctcctcttcgtgtattacttgattacagtggtacagccacccctcacttcgggtgggtggacaacatcccgcaaacttgggtcgagcaccggcctcacagcagcatagacaatggtttggaaattcaaatatgatggaatagtcaaaaacaaatagagccagtacatatcccatcacagatctcctaggttcctactttactcgcctaggttcagctatgaataaagtataattaaagccaccgcccagcagagccctcgcccctggcaagaaccaacggctatccggttatagttcgaagactgttgactcatatgtgccaccttacaaagtcattttcaacaccatgggaagtatccgagttaattggaggccaagatcctcaagatgtctaagccacagaaaccttgaagtctgttttcgaaccaaaagtatagtttcaagtaacaaaggcaggtttaaaagaaacagaactcctctgatcttcttctctagattctcacttactcacttcaacatactcactgactgtattcctaatctctcatttcgatttctttcgcaatagcatactgactatcgaactgccgtttgtggccataatcagaatcaagctcgtgatggagcggattcacgacctagtcaactccgcaagggagttcatccatgaacatcgacctgttaatggagaggccgatgacgaattcaaggaagaaaccagccctacacaatctgtgcttaccgatctcttccccttgaacgaaaatacctacccggaaaaccccaaatttgacaatcgtttcaatggaggcacactgtacatgaccatgcgcccagtgacagcgctggagagactcgccacctggcaggcggagatggaattttacgtccaagatatggaatctctcatgctgagcggcctgcactggtccgaggccaacgtcgagaaagcgggcgggtgcatcatggtcccgtcggacaacatgcccaacttgcctcgatccctgggttggctgtttggccgccgctacctgctgaaggacctgggcgacgaccccaaatggagggccacgctgtggttctatggacggaactgtgccgagctgttggagctgaagctcgatgacctctctgttgagttggtccggcgtgcgaaggctattgccccgggcatgggcgaggtctataagtttgacctggctcgagaggacgggtacaatacgaacgagttgtatgggcgcaggccgctggagggttggtggccatggccgaaggagaatcaattgaaaccacgggagtttgactgtgcagctatcgtggacgacagttcgaatgttgcagcattgtgaatgaagaggccggtgataactgtcggattagtggacccaagcatagcgttatgattttatggatgtgctattagatattcaatatctgaaattgattgagccttaagattcaggtataatttggtgatgtttgcgtttcaaagagtccagtttcatccatatgaatacacttgaaagggctcaaatggaaattccgttcactctggttaatagaagtcaaatatatattccggattttttttcgtgtattcttcccggagaaagcgattcgtctctttgatccgtggtaggttcgaagctcggatggagactgctcttggcctgacgggaacagatgcttggcactcgggtgctgctggaccgtacctgcctcagtaagtcaccaatggcacttccctctcatccatctgtatggagtaatccgattgaaaatcttgccatcgttttcttgggaccatcgccaacaattctcccaccagccgacgaacaaaccctgccgtcagagatcccgtgcgatatcgatgcaatgtacaacatagctgggtttcatagcgggagaatgcggggccggcgcggcagtagagtgtggggatgcgccgtctgggctctgctcgtaagttgtccgaactcgcagggttctgatcccagacggcagagtgatggccacaagcacgcaatattgaccgttagccaggcctgcagcaatccccagtggcgccattccactcacaccgagtccagtcgctccagcaccgaattagtaggcatcgcgagctcgcttccagcctcttccacccaccaccaacaccctgccttcgcctgaagccaacgctacccttcgacgcggcaataaaaccgggaattcaccaggccatgcagcaatgcacggtagggccgcgcggacatcgaaatgaagacttgacgggttgacgggataggggagtcacacaccaagttgttggctagcaaggctagttgggcttgcgagggtgtgctgccattgccaccagatctgcgctgtgatctcactgtgattgcatgtctcatctattttctttcttttggcagcttaccaaccaattgaattggcgggtgctaagagccatcccaccgagagcagcctggacagcgtgcagaacacgacattattgcatgccggagatttagagaaaagaaagggtcttgctccgggtggatggccattatcatacccaccaggcaggggagaaaacagccccggtttccaagaaaagaaagcaaacagcattctaaagcagcgacgagtcggaccagctgctccactcccatgctccgtcttgatcgttgcccttctgcttcatacgactctgggtggcatcctgagaggaaaccaaggctggccccgttttgctagttcgcgggttcacaaccctcaacaaaaaagaagctacctgctagtttcgattagtccaagctactggaacagccggtcttgcttctgttgtctaagctagaaaggaggtaagattgccgccgggaccccggggatcaacagcccatcctccgaaacaggagtgatgggcggctgctcttaacacgatgcgcgtgtcaataaaggtgcagattgggtgcgctgcgttgcccaaacccatggttggacagcaagcatgctctgccgttgcacacccgaaagcaccctatcgctgggtcctgattttcaacgccccgtgatggaacccttttgattgctgcctactcatgcaagtacatcccaagaaacccaagcagacggtgcctgtttgtcttctctgcatgtggcttgctttaaacacacatggtaggaatgctcggattaccgcattgggcattcccctccagagcggctagagggaatcattcaggtctaacagaaaaaaatgagacgatgaatcacgagggcagacgaagcggcagcaatagcgagagcaggttaaaggataataggctaaaagaggaccattgatgcaggaggactagcgacaggtaccctgccttgcttcgtccaacaggctttcatgcgccgctcattagtgaggtggttatgccatgttcgtttcggttaccaccaccaccatcagcaagcaagcaggtagccccgcgccagttccttgcccccggagtctctgggtgatacagagtagagaggcggccatcaaacgaaggttcctgatggtggagttaaaaaatgcttgtcctacacaccgttatttgggaggaagaaggcttgctcggaggttggttgtgtacgcctaccggtacggcggccccagccatcgcgctagactccaggcttctctcacccagatggtcagatgatcagaggttccttcataaatactagcaaggccatactcgggtaagatgtcaccccgggatcggatggctttggcttggattccagagcaatggcccaccccagcttctccagcttttcgagaagaaagggccaaggtgctcccattgagatgatgatctgaaagttgggcagcacgatgcgccttacattccttctttacaccgtgtgcttgccaagccgtccacgttgtctgtacacgatggtgtatagcagggttgcttgactgctgtttcaacaatccggtgttgcagtcgctcttccgggtcaataataaccgctgctatatgcatgcggtctattgcttcctacgcccgcccgttgatgtcggttggatgacaaaatattgccatcaagcgtgacttaagcgttgaacgaaagtgctctacattgccgtattcgatctagccaacttgaagcttcgttcaccgagacggggactcaatctattactcttaggcattactaagaggccagctctcgacacatggctagcaagggggaacaggcactagggcgtggagaaggagagagaggatctaaccgggagagtcgggcacggcatgggcagagaatgcaagttgggaggacattgatactgagccagttcctagcgaggtgagcagtcagatcgggcgcctcccagaaagttggagacggcaaccatctagctcaattcaacgctagctcgaaagtgtcacctggcccgcgaatcctgcaccttgcatttgccagctgctctgtaaaagtgggctggcgggcgaactgggtgacaggaggaagaggatatgcgagatggagtgatgtgatggcgagtcccgttcacacttgatgctcgtgctgctctagctctgcccaactctgacacagtgacactgcagcgatgggttgcgctacagctgtcacagcccagggagccagttcgggctgcagccggtgtgcagcaccctgtccagaagcctccccgctgtaattggccgtggtccaggtgctaagcttcctgtagcgtgccctgaaggcccaaagcatcctcctgtcgccctcaagccacgctgcacagtcgccgcctcattcatcctcctgctctcgatcaaacagctcctcccatccatcccccagctttcgtccatacatgccttgcctctgcccaccccctacaccataccattccatacccgagcagccagcctacctgctcgccggccatccagcctgactctttgttactcgctcgcttgtcggccctagctgtcgtcgtggtaaatgaataatccggtcctccaccggggcgagccgcccattttccactgaccttctccgccccaccaagctgtcttccattgcccatcatcgtgaacacctccctccctcgacacacctcttttctccccaatcaagcatcccatccgccatgtcggcggacgtgattctttgaattgtcaacctctgcagctgattctgttgcccaagcgcccggctcgaagcgcctacctaatacccgcgtctctttttttttctttttcccccgttctgtttctagctgttcatgacccgtttggatatccatcctatcaaccctgcttaatccatccatccgcaaacaaaaaacctcggtgcgacgcagccaatcccatctcgactctagctcgacgctctttcagccaaggcttcctgtccgcgcaccatgatcgacggaccatggcgacgaccttaatgaacaagaagtacgaagccgaccctcctccgccgcccaggcaaattcgtttcgtcaacaatcagggccagcctcccttgaagcgccgtcgaatcacagctgcgtaggtcttcttcacatctccttgtctcacccgccaccacatgttcgaggaccttgacagtcgtgcaccactatccaccattggtctacctcatcacatgtcagggttgccgtcgctagtaataagggagggacgaacggatcatgagctaaccatgcctcggctttcctctcctgcagatgtctaacatgccgccgacggaaaacgagatgcgccggcgagcgacccaagtgctctacgtgcacaaagaacgggcacaaatgtctggggtatccggaagagaagaaagagggaggtgatgcgggggacggcaaagtcgacgactacgaggagaggcccgacatcgaggacagtattgaggaagacgacaagaagccaaagaagctggccaacatcatcaccacgcagcaaccgcatcagtcgcatcgcaggtccggccctgcctcgtcgccgcaatcaagtacccgaccgttcgcgaatcaacatgccaacgcagtgtccccgacggtgcccagcaaagcgtcggcatcacccacgatgctaaccgcgccgacagctgcgagctcagcccatcccatgccggctcagtcgatggcgacgcacaactccctcacatcggaagacccagggtccccaagcatgcgccggagcatgaatcacagccatcgggtgccatacttccgttactttggccccacggccatcgttccaggattcaagcagatggttgtatctgttcgggaccggcgtcgctccaccaatggctcacactcgggtgcgtcgccgctgtcgaaccccagcggcatcatgggaagcgcctcggccgccgacagcgacgtcattctagatgaccctccgatatacgacccgaacgaccctgggccggtgaatcccttcatcctgagcctggccaggacgttcttcctccatctcgggtgcaactatccattcttacaagagcgaaacttcatgcgactagtcagggagaaacgggcggaaccgattctagtcgacgccgtgtgtgcgctggcagcacgtttctcggactcgcccatccttaccggcggcaacgagaaaatgcccaagacggagcgaggacaggcgtatgcccatcgcgcaaaacgggcgaccgtcgacaccttcccctgccccactgtcgctgctgttcaagcatgtttgctcatggcctacgaaggattcggcgccaatcaggatagtgccctgtggatgtatcttggcctggccatacgaatggcgatagacttggggttgcagaagcgagtgggtgttcagtaccagggcgagcatgatccttggaacacccagcagcgcatgcgaaatcttcttgggtacatcacccctgacgaatccaaaccacagagcaacccgccctctcaggaggaacaaagggagctagagcaagagcgcattgatactttctggactgtgtttgtcttggatagattcatttcttccggtaccggtcgtccagtaaccctgcgtgaggatgactatgatctccaagtgccggagctgggtctcctgcccggaactgcgtggccaaatcccttccccgtgttcctcgagatcatccatctgtatggccgtgtatcagatgttctaaacaatatccaggatctaagtgatctcacacgtgagaagtggcagaagctgatcaccatggaaagccggcttacgaagatgtacaagagctgggactcacgtcttcagttcaatgtgaccaacttcaaggcctacctgagcgccggccagggcactacgttcatcttgttacatttctggtttcatgctttattcattgttctccatcagccaaccttgttgaccccgttcggcgagcttcgaagcgaacttcagctgttgcccgacagtcgtgagcttagcatgagcagcgcaaagacgatatgtgatatactcgcttttgcggacctgatagacccccacagcttcattggcaatccattcacaagccagccaatctacattgccgcttgtgcattcttgatggagtcgagcgcttctgcttcagaggatccgtcccgagaaggttcaccacgactcaaggagcgatcgctgccgtcaaacgccaaccacgtcaaccatggcaataatggaaaacaaaagtcgcgacactctttattggcatcggcggcaaatcaaaactaccagcaatgctatagatcattggagcatctccagacgtactggggcggtgtgaaatatatcctcacggcgttggatcagaaagccaagggaatctgggattgcgaaacatttacttcagaagaatatgaaagcacaaggatggcacggactgaggccatcaatggccacctcagattcgatgctcccacttcatccccaacagtaccaggcccccccatcgcgtggagtctggcaggcacagccaattcacccagttcgagcttgacactgatgtaccagaaatcgaacacaaaccctactagccgtgagataatatccccacagcgacagagatcaggcaacaaaccgattggcaatccaatggatggctcaatgaggcagtcagtccatgcggccacaggcatgttcccgcccccgatgccccaggccaccccgtcggcggccaagggctcccctgatcagcaacaggcttctcaccccgcaaggccgagccaacgtggtcagactgtggtcaaattcgagggcctgtcaggcgagactgagacggacaatatgtactcatcacaccacttcgcatcctcgagtcaaccacagcagtcaagcggcatggaagcttataatacctcaccaccgaacacgatgacagacggaaaccatactgcaaatcacaatagtgcgaccagcaacatatactatagccaaggcatgccgtatcatccaggctggggcaccactacagggaacatggatgccttcacattcgatagtcaggacattgacattggtgccttgggtcttgaacagccgggtctcatgggagcctggttagactatatcccaccagacgatgtgttgggattattcgaacaccacgatatggggcatggcggccaagggggaggccctccagggggaccataagcatgcctctatcgaagtgttcttctttttttttttcatcccttttttaaacgaattattattcattgtttcctcagggaggagggaacggtttgatgtattgaaggtagtatttcacggcagaaccgggggcgtatgaggatttgcaacaatagcacacgacttggcgttatactatggcatgattcgggagaaatgatgggtttcctatgtttttttttccaattctagcttgggaatggcaggaatttaggatgcggcacgcgtgtcgactatgtttagggaacgaccaaagacaaaaaaaggcgaaggtagtttgcgatcaagagcagcgatgctcaaataccacgcgagactcttgggcaacacgtctcgtccagttacgtttctcgccctttttgattgtttattttttttttcttatatcatatcgtcgctgcttatgatgaccggccgggatgcttacctgctttgttggattatgggtgtatactgagcagcgactggatgggcaggtttttttgttccagggtggaagacgtctggggtgcatagattgacgatgcaggagggtttcttttcagcgagcattgcctgggttcttgtttgaccaggcgttgattgaggtgagggtatatatggtgtatggacttatatgatttagcgctcaggattctgggagattgtctcgatatggtgggtgtttgatagccaatgtgtctaatcagaaattaaatccgtgctcggtctcttgtggatgatttatgagggtattcctgatttctagcacccatttcgaggtttagaacaatttgaaagggatgatctgtatttgacaccgtcgtgaacacaactcttttagaggtatgataaaacctctaaagtatagcacatagtcagtttctaggcaaacttgacatatgtatcacaggcagctatcttcaggctaagtgaaatggtttagaaaatgaggttgaaggggttgaggttggacgagagcatgtgtatagggtagcagaaggatcttcagcctcctcctttgaaagctatgacaagcctaccataactggaattattgctctagcttggaattgatgctgacattaagatataccaccagcttgcattgtgtaaccccattctaggtgtttttgaaccctcttattgttcggcgagtcgggggtagaacgagggctactaagtggtgggtcgctcagatggctcaggcctatcaaacacagacagactacataaggctgaggggacaatttcaacgactcaagaacagcctcagctcgcaaatctcactccagcccgtccaattgaccaaaccagtcgcttcaaatcaccaatacacataataaagcaactccagaagtgaattgacccccccacctcctcccatgcggcctctccgtcacctggggcgccgctccatcctcccccctccccattcccgcttcactacccccctcataccctcacggcaattcagcgaatccgccgcggccaacccctcgaacaagacccagatctacgtctcccgctcccacgatcccctcacaaacctctccctcgagcaccgcctcctccagacctcccacccggactcgaccgtcctcctcctctacaccaaccggccctgcgtcgtcgtcggccgcaaccagaacccctggctcgaggtgaaccaggcccggctgggcgcccaatcccacatccagctcgtcaggcggcgctcgggcggcgggaccgtcttccacgacgagggcaacgtcaacttcagcgtgatatgcccgcccaaagcgttccaccgcgacacgcacgcggagatggtggtgagggccctggccgcgctgggggaggggcgcgcgcgcgtgaacgagcggcacgacatcgtcgtcgacagggacgaggggagaacgttcaaggtgagcgggtcggcgtacaagctcacgaggctgaggtcgctgcaccacgggacgtgcctgctgcggagccctgggctggcgcgcatctcgggcctgctgaggtcccccggggaggcgttcatcaaggcgcagggggtggacagcgtgaggagtcccgtcgcgaatgtgggcgttgagccggcggcgtttgtggacgcggtcgtggccgagttcaggagcatgtacggcgggcaggcggtggaggtggatgagtttggggaagaggtgctcgaggtcgagaaggtgagggagggatatgaggagatgagggagagggcgtgggtgtacgggcagacgccgcggttcgtgctgtcgacggaggctacggaggatgatcctagggagaggccggcggtgccgtttgaggtgagtttgggtttcactctgatggttcaaggaatctagacacggcttttggcttctttgaaagagaagctggccgggaaatttcttcatgacttgacattaaggctatctactttagttgctaacagtttcgcagtccaagctctacatcgaggccaagcgcggcatcgtcaacaagttaacactgaacggcacgtctctagactccccgtccatcgtgggcgcctccatctgggagatctcggattggaccactcggctccgcgacgccggcgccggcgtcgacgacgtgcgggaggtgggagcctggctcaacggcgtcctcgcaacacaaccatgagctgggagagagaaagccgacgtggaacccacgtaatctatgtggacatatccaagcctcacaggacgatgtggtgtatgtacgcgctgcagcgttacgcggtgttccgtcatcccgtctggccaccccctacaatggatgaacgtgaagtcagctggaccccgggggcaaatgtacagttcaaaggccgaaggagataagggagcctcgcaaatacgaacaagaagaccgggggacaatggacgtttcattcaactggttttgggtggctgcctagcgcaggcaggaaagtgatcgtcaatacgagcggcctgtaacatgaagaaccggcactgggcttctcttgactgtctcacttcctccccccccggcgacaggtgattctctaaaagcaatatacacgtaaacggatgggcggacagtgtagatttgatggatggatggatggataggtggagcagtagaaaccgcatggatcagtagggttccatccggaggggacgtgggcgagaatcatgctcctccctgggtggtgttcgcgcgatatgcagaacgggatgtcgctgcaggtaaactcctcgccgtcaggcgggctcggcgatcaagggattctcgttgcccccccccgattatcagatgcaagaaataggttgatatttcgtagggtccttcttggggtcgatcacatggggtagcatcctgttctagcgctacccaccatcttctttcttgttccctttgttctgctacattgttcgtaatgataggcaagccctcggagattatgggaccgcacactctcgaccgcgctctgtcgggggaggggggtggtatgtcgagagaagtcgacgttgcgccttgggtgatagttatctcacacagtgtggcattacaaagcaggtttcccgtacacttagccaaagtccggacatggtgatcaccttcattttacttgtctcacgcatatgagagtggcggccccaacagcaactagctctcactcatagcaggaatagggggagggcgataacacccaccatgaagtcacgatgcagggttctgtgtccattcagggtagttagggtagaagacggcgagggccaagatggagaagggggcggtgaccattattcgaagacgtgagatggttgcggaggagggtagcagggctgtgccgtgctttgtggatggatgtaagctatgcaaacaggctgcgaactattccctcctttacccatccccgtcgctggacatacgattgggaggtggaccatgtgcacagcagatgacgtacagccggataggcagggaaccgcgctgcgacgcaagcactcttctcaccttcttctttcccggagtcaggagacgagtcttcggacccgtggtagccttgcagagtcccctggaggagggcaggaaggctggccaactgctgcattccccttccttgcacttggggcatccgacaggttggcacttgcttaccaggccagggggtcaacgacgacgaggggtggttagttggggctcggttgacactggcgacgagggttcagattggctagcacgaggcgggcgcgagtaagaggcacagttgggtgtctatctgcagcgctaaccgagaaccggacgagagtgcagatgtagtctggatgcttgttggctcttggtcctggggttgatgaagggagcctcggggcatgccgccgtccaacttgggcttggccgggtagctgcatatcgacgacagccggccagtagagcccccccccaagcttctggaccatcgtgaatcattctgggagctttcatcacatgtttcttactcgacgggcggcatcctccgctagggcattaatccggtacacacaccggagcaggttgttgaatgaagacgcccgccctccgacgatattcaaatagacgaggcagaaggaataaacgcgaagtaagcgtcaagggatgaggatccctggatatccccggactccagcccatccggcgatcggtcgcttgcgctgcgcagatagcacgtacatatcaagcaggcatcacgcacgcacatcagtagctgccagctgccggtacttcagtttacggtcattgatcatagtggaaactagagtagcatccttgcttcgaacttcccccctccttctcgcctttgccatccggagtcggggattggctgggagggtattgcggctaagatcggccagagctgggccagccccagaaaaaaaccaagccgaaatagactgcgccaactctctttggttatgctaccaacatggccgaacaggagagttcatactaactgtgggtggacgggtggagaggagcaactcctccgccataacttggacgatcgtcgatcgcgcttcaaatatatgggtaaccgaggactgcgcgatatctaagaatcgagtcacggaaaagcaagaaatgcgaatgcatgacttaaccacatgaacggcgaagcgaaggcagatcatgatcgtaggggccctcttttcggttgggactcgaccgtgccgttcagaaaactatgctgccaccacacctcgacacgcatgcacagttgggctggctatatgtagaactgacggggttggatgcatgccagaagcgagctgccacgcaaggcccggcaagcgcctacggcttgcatgtagcctcgatctactggagagagaagttgaaacacgctcactgggtgcaagcgtgcaagcgagaggacatccagtctaagcagagccacccatgggggaagtaggaaatgaaggaatgatggcatggagcgatggatgggcgaatacctggggtaagaacggtgtgatgctaatggaccatggcccttgggctcgacgacaggcgactaatcatattcttgttgtaatggccccctgcccttcgtcgcagcctggggtgcatgccatgtcctggacatttctgctctgtgcatcatgggttgggattggctcctccaggcttgatttgccaggcgggtgacagcccccaaggaaacattgggtatttgggggaatgaggtgggagaggatgcgggagctaagtttggttgaagcaagcaccgggccgggcagcgtcgtattcaatcactcgatgagatgaacgagtgagaacccagcagcacacacccacggctgctgtcacacacctacacatggtgtgtatgcgtgggtgattgttgagtgacgggtagcagggaccagaggccatgggcagggtgcaagggtaaggccagggccatgtatcatagcgcgagagacaagatgggaagagagagggaacgagatggtggttttggtgatctcgtcgcatcgtacggtcgtgcggtcttggctcgacgtcgctagagggcccagagtggtcttttggtcagatctcagaaatctgtgcgggccgaagacgcccgaatcagacgatgatgaataccggctagggccttctcatgagagccaaccagggggcggcaggggacttgacgcttgctgctccagggtttggccaagagccaagcccaagggccatcaacgcgagagagatgctatcaggctatgtagcaactagtagaacaagtgtttgagtagtgcgtcccgtacatgcagacgctctcgagaagggtggtccccgaggtcgcctggctcctcctccgcaactggacgaggggggttcacagcagaacgacagcagacgggtgggatcccgtagtgtcgattgagtttgtctgcctgattgattgatattgggcgcgccacagcgttcagcggctgccacgtctttgccatacaggaactatgcacggatcgcggtggtatgtcgggaggggttgaagctaggaggctggcagggttttgatttgtgccattttgctgaattctatttgctgctgggcggcctccctatctcttccctcttctcccatcacacgatgtacgtgtcgccatgttagtcgaagaaggagccatccagttgcccaaatgtattgtgatagggccagggggggtagccgatggatgtgaacaggatggaatagccatagaggcaaagcagaggccggcaaatatttgagtctgacccatgctctttgttgcagggcgatcacccgttgtcgcttgcaacgctacctccctagcccagcgcacagtcatggctaactgagggagacccatgaagtgctcggaaggaggattacctaggcgtcgtagcgcagtgggactgttcccttcctccctagtgcgagtcgagggagctggggaggtggatgcgatgtgggtggttgaagctggtccgtgtcgagtgcccacacacagggcctgccatcatgattcgggccaatgtaccaccgcggttcttggcattgaattgtttgcatgaggaggctaactggagagggagacgaacgtggatagatcagccatggtccagctcttctctggggtgagctcattactcgatgaggcgtgcagctgaactgcccccagaaacggacacacgctaagaaagataagaaaatattcatccatccattcctatgagagccagctgcggctggttggctgactggcttggatggtctgtcttcttgtctcgtcttagcccgcctcgtttctagacagactttcaattggtgcgtgtgtgtgaggaacaaacaacaagaccggcactgctgccggtggtcaacttgctccatatcatatcatacctatcatattatccaacagtcttactgtacctacatgtgtacacaggcgaccgtggcttggagggtgtctgtcgcaaaagtagataatggcgcaggtgtgaaacatgattgatctgtcatcatgttagtttgcctctattgtccacattattaacttcgtatccattttagcgctaacggcggataggagaaagaagcgataggaaagagggaggcaatcatatgtcattcctggctgttccaggccaacttctgttgggcttcgatcccgagccgatagagtgcgttgtgaggtagcatagggaaagggacttgttggcaaccgaggaataacacccctgagcaaccctaattgaccatcgacgggcaaatgtctttgacgtatacggggatcatgggtgttgggcaataatagcacatccatgcctgctccagtaccaggctgcgcacgcacacatctttctcaagcacccatattacgtgcatacagctgccggtgtaccatcacctaggtaccatgtatcatgcctgaagagactgccgttgcaggcgactctgccgagggagcatcttcaccctgttacatttcgcccttgtacatacgggctgcatccccaactggccgatccacctggtgatggtgagtgcattttgcaggacgcggcttccatgctctggctctggcccttcccgtcgcttcggaccagcccccgtcgaggcatgcaagaaatctcaaccacatgtgtgtagtacaggaggcttcgacacgccggcaggcagccgttgatggcccagcccgcacgtcctgagggaggtacatagacggtctagtcatgtacatgcgtacttacgtatgcccccctaaaatgactactgcatacaggtagtagaaatgcaacttggggctgggctcatgcaaggagctgaaagagaccctgagacagtcctcacagcgggcggaactggcgtcgcgtgcgcccgcaaacgaagggtggcgcgacgccgaggctctgggacgagacataacaccatctggtcttttcggtcttgtattatctccttcttgtcatcattgagcggttgttttctcctttgattacaccaggatctcgatccggaggattccgccccttgtcttgcccacagcgaggcgtgcctccgatccgaatcagggcattgataagagactgtggctgcagcaagacaacgccgtggcggtgccttttgggcggatggtcgtattattgctaggtacccaatagcagatgagtgccgggtatcagactcttgcgcactgccattccccattgacgtgtgtgggcgaagtaccctcgaaccgtactatgtaggaacattgtctggggttgtctccatcgttgcaccacgaggagagcacaggcacagacagtcaagacccagagtctggcattgcagtccagggtggttgaggtttgcggaggtgacttgaggggggcgcttggcagcattgggcatcgtgcagccgccttcctgtgcgtctgtccgcgaagggtataaaccgggctccagaccgtgatgtggtgcgatgcgatgcgatgcggtgcgctggattcgacttggaataatcttagctgttgtcctcccatgctgggccaagtggaactatggggtaatcgaaatgtacctacatcaatagcctgtctgtctggtgttggtgctgctgctgtggtgatgtgatggatcgcaaatgtcaacccgcttccacactcttccccgtccagtgtagctttggaatgcgacgggactggggccagaatagggtccgcccgctagctagcaatgacgccagtctgtgatactacgtattaattatgtgcccctccaaacttggtgattgacaggaggatggaagggtgaatggatgtgagcggagtgaacccttaccatcatctccgcggacgctcgctgcgaaagggaaaaacaaacccaagaccttccttggcttattagggtgtgtgagacataggacctgtcatatttgcagctggtcgttttcgtcgtcccagccagccatccaacgcttctccccaaaggcagaactgcactatcggatcccagtcaacaatcgctgcccaatcaggagtaccggcgtgggctgccattcttgggaagaggcatgttttctcattcagcagtaggttgcatgccgtaaagttgcatttctgcctgcaccatgccgcccgtgcatggggattgattaaaatgtacaagagagatctctgcggcacagcgacggacgaggcaagggggagcctggagagtagctcaggtacctcaggtcgtgcctgccaactgaggaaatggtgcacgcaatttgttctgcttgttctccagtctgtattgctagtaacaaaaatccagggctgatacattattcactatcaattgatgttatctttgtattgctgtatttatttatctattgcagaaagtgctctgcccatattcgctcttcaatttgatgtttcatttcttctgtcgcgcagggcacgtctgggctgtagcttgtatgtacatgtgtacttcggtacagggctcgcttatctttttgggatgtgccttatctgagactttgaccacttgcgcgcgttaatagttatgtcatcgccgacccccagccaatcagaagctccgatgcactttcctggatgcgatacaggcagggcaggtgcgaggaatgcaggaaaacaacatcaacgcaatcatccccaggcggatgacatctagacattggcagagttttctaatccagcgcttgactcgacctgattcaaggcatcgactcagactagcaagagctaatcaggcgcagagccgtcctgttatcggagagcgccgatcgatcgaggggcaaaaaaagccagcccaagttggctgcaacgctaccaatggctcgactaactaacacaattgtttcgtaggcgggaaagggggaagagagggaaaaaatgcaaggaaaaaaaaacaactctcgcagcaagcataagacattgtgcgccagatgtactatgtaagacgcctcggcttcagataagcgatctgacgagcatgtttcatggtctggggatgtgctagttcctcaacaatcgcccctccccctatcaggaccgtcttagttatctatgtttgcttttttgcttaaatagtgctgcctttgttacgtagatatgatgtatatgcatacctaggcccaggtatagaggccgccagacagataacgggcgcccaaagtgaggtatcgcaagagcttgcgcccaatgcagccggaatattgaggcccaggcccctaccctggcccattggaccatcacaggcagagacacgacagaggcacggcttgctgtctctgacccaaaagcagacccagggcgaggaaccagacaggctgccggcggggccaatggctcgctgggcggagccggacatgcaggctaaggcaaggcatgggcgattgcagccatccatgccccaccacccaccctccacagcaggagctgctgctgcaacatggacatccagactctggcccagggaggcccaaggctaaggggtgccctagctctgaggctacgtcagggaggttctgggcccctccaaccaatgccagctatctcgtacggtgcatgtacgtgggtgggacgggctgcccagagaggagccgacttgctccgaagcgtggccttggccttgcagtgtgttgggcagcgctgggcgcgttcagtgacaaaatgggccttgacgtcgtccttggcctcgaggtacctgcacagtgtcgcagtgtgcagcattccaggcgcccgcccactgagtgctggcccaactgcaagtggcggtccagcagcactgcacagcagagcaagcaagcacaacacagagcacctgctgtgcgctctaacctccgagggtacttgaattcccctcttttgcgacaacgggcggaaatctaccagatctcactggccgagtttcggaggcggtcggcacgggctgatcttcagcgccatggcaccatgaggatagatcaaactgaggacaaaagcccaaaacccaagaataactaaaataacaagcggcatgggccatgccagtgacggtgtctgaagccaagacctcagctggcagccatgcatgtcaatcagtcaacagcaagcgggtcgcctctggctgggcagcgagtgaagagagactccgttctcgcccaagacacagtcgacgctcaatgccaccccaccagcctcttgcagttcggtgcacaggctgcagtaggcgggaaaggtacctccgtgccctgtccgatggcacttgagcccgcccaagcctggtgcggcgtgattggctggtcacgctatcagaatccgtgcccctccaccacaccctggccccagcccagtcggcgcccctgctcgtgcataatccactctaccttaccctacaagttctctcccacagcccaccagggaggtaccgggctacttgctcgcccacacccacccaccgcgcatcatccaacaccaccaccaccaccaactcctccccatcaacccacaactaacttctaccaccaacccaactcttgcaccccccggttcgccccaaaagcgctgatcaggacctactgtgacgccgccgtcttcgtgcagctggtccttgaaattcaattttcccttgtttaactctctcctggtttccatttttttccacatcacctcctctccttcaacctccggtccttacgcctttttttttgttgcatcacccgccttttttttccttctcgactcttcgcacacaaacaagtcgcccgccatgttgcagtaaactcaccccgactctcgagtctgaaaggcccgctgcgcgagcccgtcctcagcttcctcagcatgtcgaagcacatctcgacgacctctccatctcgctcaattgtgttatgaccgccatggagtcctcgcaacaaccacaacgtccgcaccatcggcgtcggccctcttcaccgacgccgattgctcatacgcaccaccgtgcaaaccaccaccaccaccaccacctacatcgaccctcgcaacctcaactgttcacacattttccacctgccgcgacattgcagctgcgaacctcgcacaatacccccgcttcctcgccgggcctgttcagcccctcgacgcatcgcaatccgcttctcccccctccgacctcgctctccgagagcacctctccagcccccggcaaccacccgtatctgcacccgctgcagacctacaaagtcagagagtgagtacacattctgacgcagccaagagctggattatttccgcccctcatctcccttgatatccccctcctccggttgggccacgctcatttgccgtggctgcccccccccgcaaccgggcctggttgaccaaccaaacacacaagtataagaatctcatgtggtacgaggttacacatttcagacgacgaggctaaccgtggggtttccatccatgtaggacgcacaaggcgctcatcgactccgacaacatcacgggccgcaagcttatcaatcaatatgaggtcattgaggagattggccgtggcatgcatggcaaggtcaagctcgcacgcaatctcgagacccacgacaatgtggccatcaaaatcatcccgcgcttctccaaaaagaggcgtctgggtaaggtgacggccaaatcgccccaggacaagaccaaacgcgaaattgctattctcaagaagattcgccaccccaacgtggtcgccctcctcgaagtcatcgacgaccctgagctgaagaagatctacatggtgcttgaacacgctgaactcggcgaggtcatctggcgcaagaagggcttgccccacatctaccagtatgagcgccgacggatcgagcgcgagatggcaggcgagccgcgcaccgaggaggaggagcagtatgaccagattctggaacagcgccaggccttgaaagactacaagcgtgcccgaatggctcagaattacaacgtctcttctgattactggagtgtcgagtacggcgccgccaacgagcccagcagctacggccaacagtcgcgagtcacttccagggatgactttaccaatggagatggatcagtgtctcggaccagctctcgcccaccatcacgcggccattcccagggcccctcgcgctcccactctgctgcctcaatgggcatgagcatggctttttccgacctggaggaggaggtcaattgggatgacgagatcgagactcccggccccttccgttccaaccccaactccagcacagccctggatggggccatgtttagccagtactcggaggatagactgtatcggggtcgccggcccagtgtggctgattcaatcatctctcacatgtcttcggttgactactatgtgcagaaccacgacgccttcaccgacgacttttcctacgttccgtgttttacaatggaccaggcgcgggccactttccgtgataccgtgcttggtctcgagtacctgcactaccaaggtgtcgtccacagggacatcaagcccgccaacctgttgtggagcaaggatcatagagttaagatttccgatttcggtgtctcgtatttcggccgccctatccgagatggcgagccggacgatacagtgtccgagtctgaggcgaaggacttcgatgatgatctggagctggccaagactgttggaactccagccttcttcgctcccgaaatttgctacacggacatcagcaaggagcagcccaaggtctctgagcagatcgatgtttggtcccttggcgtgaccctctactgtctcatcttcgctcgcattcccttcctcgccgaggatgagttccaaatgttcaagaagattgcgacggaggacgtatatattccacgccggcgattgctccctgtcgacccatccacctcccctatgaccacatctctatataatcgacacagtacatacccctatcgcaacgataatgatttagcttatgaggagattgaccctctccttcttgacctgcttcgccagatgcttatcaagaatcccgagcagcggattaggcttagagatatcaagagacatccttgggtcctccaggggctttccaaccccgtgggatggctcgacgatactgacccgggcaggccctcttctggccgcaagatccaggtcaacgagcgcgatgtgtccgacgccgtcgtgcccctgaccttcctcgagagggctcgctccgctgtcaagaaggctgtcggcaaggtgattcacccccttgtcgagcgaagcgacagcagaactcggcagcgagccacgagcagcgtggcaagctcatctggcgacacaagcatgttcaacggccctcctacctcccatccgggggaaggtcaagggcgccgccagagtctaaagcccgatgactacttcgctctcgccatcaaggacaacctagcagcacgagagagatccttcgtatccgggcttgaggtttatgatcccatggcaactgtcctcccccaagaggagcaaactaagccggagagtgcggagcaatccgactccagcaccaaggcggcccagctccacagccgaacccccagcagggcggggctgcatattaggacccgagcttcccgtgtatttgagtctctcacgacacccacactgggatctgacggtgcccgtgacaacgaatttcgcgatgagacgagaaagacaagagcatctacactgcccggcgacgatgcatctcgtgctcagtcagtagatcgtggtttatttggttcaatggacaagcacgctgctgcccgggtggcagtgagccctacgacggctggtggagatattcaacgtccaacgacaccatgccatccccgcgctatgcggtccgtcgacctgggacgagccaagaagcgccagagctacgcctcacctctggggtcatcggttcaaaatgcggtcattgccgccattgaggacggccaggtcccaagagagctcgcggcccctcgacccggatctcggagacacaacccttccaactctgagtcgaacataagggccggttaccccacttcacgctacatggatggacagctctggggactaagaacgaccaaatccgaccccgccgccattccttgtcccccttcggatgaagaggatggccctgcacgatcggccccaactcggggaaacacaatgacgactgtcaagtcttcaagcaccgattctctagacgggctagaaacgcccctgacctgcccaagtgaggtgaccagcccaacttctacacagccaccaactaagaatggttcagagcaaacgttggccttccagtccgacccatcgctacccgctctcctcagtggcgccagttcagtctctgctgacatggaagccgagctgctcaatgggccgggtgtggtgagcacgaagccgtctttgctcgagacgacagactcgctcacacctccagctcatggtaaagaacctactggtggatttccattggatcaagtgttcggcaatccttcagccatggggagcggatcactgactcttcgggtcgatcacgccccagacacgcatcggagccttagcgatgatgacgatgatgatagcgacgacggctttctcgttatggccaaatccaagcgcaagtccacaccagttgccagcctctcacgccgggcacctttcgaagccaggagacgggataccaacattagtaccaccagtacagaaacagccaaacccgggcaacctgagcacacgcatacgcatacccatcagtattcagccagtatggatgggcccttttcctaacagggacgggccttccacaccactgtagagacgttgggaagcaatgcctcggcaagcttgaagtctcccccatcattgggctgagcaatatactcaaactgctatttttcttcaatctagtttacagatggcgggtacatttttgatgataccacatacaccacacgcactgggaactgcttcagacgcagcaatatttccaagatgcatttgacagtactagactacaattccccgatagacatttgttattttacggcagggtgcgtcccgccatgcttgttttggagcggccttttgtctttttacagcatttcatcgtttctgggttgcggcaacccaaacacattggcacttttttcagagcacagacaatgagatgcactagtatgatcgatcacgtcctttcaacacgattatgacggcatgatgcctgctagtcaggatgaagtcacggtccactcaggaacacgcacgtctctgcaagtcattagctgtcgagagcttgtcgtcgccaaacacgctactagctcttcgctgcacatgaagattagacgacgaacaccctcagtcttgaagccgaacatgggggaagaactctaaacgcgccgctgtatctatatcataccaaaccccccttcccccccgagatggatagcaaaccgtctgctccatgaggataatccttggctggagggtggactctccccctccccgagataagaggaatggtttacctcggtactgggttttctttttctatgtccaatacgtcgatttgttgagcttttttttcccccacgggcagcatagcatggcactggtgaagaatttgggagtgaaatttgggaggatcaggggacacagcagggacatgccactccccccagacacatgtttttatggatttgcgcttttgatttgttccgcttggctggactagtaacccccgctcttgctcttcgtttttatcagtttttgggaattatggagaggctggctgtacgtggggagcggatggtacgaagatgggattttcccccttctccatggccgcatccccacatgattttatcgcgtgacatgggttcaagttggtcaatgagttttgggtgtaatggtgcgatgagagtttgctgggtagcaaggttcgatctcccacgggaagacgagacacgtagatatatggaatgaaatatagtaaacccaccacttttgcccttttttcagtgataatcgctaatgagcactaagacatccccgtatcttcttttcggccgacttcgaccttggcgggtctaatcattgagccgcctgtgtcaagtactgttctcaattattattattatatgtacatatctattcttgaatcttatatatatgtcatcgcatgtagttaacgcggccacatgtgaagaaaatccaggttcaagggggggggccgcaactgatcaattctttgcgataatatggtggtctagcaaaattctaatgtcgagagacggcgatgatatagctagtaaattgattctgcccccctttgattactcggttcctgccgatggaattcaatctcacttggaggacgccgagatgaagtctttgaccgtatagtacgactgggaagcaacgataccaatgacgaaagctatggcgacaatgaagaggttcaaagccaggggaagcaagaatgaccggttggggggaacggaacgcatctcgctcacgatatcctctaggtttcgtgccattgcatcccggctgaagttgtcccttacacgctttgcgccaaggtcaccaagtatgttgatctttttatcgggcatgtcaagagcccggatcatgacctccgtccaggcaggtatatcggccgtgtcgcgtaaccagcctgtctcgttgtcaacgacggtttctacagggccgccggtagtggcagccaggaccggggtgcgagcgagcatggcctcgagagggacaattccaaagtgttcctgagagggggtgtagacaagcaatctcgcagctcgcaggagcttgtccttggttgcgccaggaactgatggtaagaataggactcgagagtctggagatgcggtagagagatcttccgaggctttgattgtctgatgggagacggagagggtgtctgctagagcttgaagctcagtgtgatatttgacgttttcatcgatccggtggtcatagccccctaattattcacacattaagtcccgggatgtcctgaactagtattaggacggtggcgatgtcatgacatacctgcgataacgaggcggaccttctgccgtttcttgtccggaattgcggcaaacgccttgatagcaagcgcaatgtcctttttcctttcaaagcgattgatgcttagaatgattctgtctcctccaaagagcttctcagcctcggtagacggttcctcgtttgcgcctgtctctacacacgggtagacaaccttcatgggactgcttttcgccaaagccggccaagttttggcgaccacgccctttgtgaaacggctgttcaccgcgatggcttgcgcgaagcccattgtaaactcctccagccagtcaaatggtacacggtagagtcgcttgatggtcttctcgcggccttgtgcaaggagcatgtcggggaagtggcaatagaatagaatagggccggaggtaacgaagtattgtaacagaggcaggccagcggagagctggtcgacgatgagggcatcggggttcaggttggtcagctcgcgggtgtaattgatttggagtaacagctggatgtggcgggcaattgcgcagaggatggtgaaacgattgaagatggacatgggcaccggcccagaggcgcgcacacggacgtcgagaatgcctgcgaagtggtgtaacggcgattagtaggatggtcagtgaagcggggggcagggcgagaagcagggcgcttcttgggcgaggaaccacaatataccatcgggtttgcactcatcgaagcaatggtttgggtcgcaatggttggtgaagatgacaactttgtgcccgcgctcctgaaggccaacggcggcatcgacgacgaggcgctcagcaccaccaatgcccaggtcggggtggaagaagacgatggtcctcttcctttcgctcgggtcggtcttggcgtcggcgtccttctccttagccttctgcttccctccggccttcgcgacagctttgcgcgccatcgtggatgtgaagaaagtttgtggggttggaaaggagcagagaaagtgagttgaagctgaagtgattccatgccgccaccttcctcaaaagccagataagataacgcccgagataagatattcctgagagacttattgacctattacgaacaaccttgcaacaagaacctcgaagtcgtctagttggtttatggcgccagactgtaatcgtttgaaagcatatctggatgtcagcggttcgactccgctcttcgagattttcttttttttcttttttttcttttttttctttttttatctgatatcaatcttgtacgttacttttcgaattgactatcttgaatatttcaatcaatatttttaccgggaaagcaggaagtttgacagatagcattttactcaatttagaagaagcgcctatccctgaatacctaatttttgggagcatcctccgataaaggagtaagctctggaccagtagtaatttctgctggagtagcagcccctgatggatgaggattctccggcggagtagcaacctctgacggagctgcagattcccctggagagccgagatgctttttgaagaaggaaacgatgcgcctgtgcccatacccagagcagccacaaccatgatgcccatccgggatgaacaccaactcatagtccttatcctgctcattcagagcctgcacaagcctcatggttcctgccggattcacattggtgtccagcccccctacaaccagcatcagctgcccctctagtttccccgcatgggtcagattggagtggtcaatatacgactggtcgaccgggtagcccatgcaggactccgcccacgagaggtagtcgatgcggatgtcgtgggatcccgagtctgctgcggcaaccttgtagaagtcgccgtggtgcagtatcgcagataccgtgttcgtcgccccggcggacgtgccgacgatgccgacgcgcgagagatccatccagggcctggtcttcgcggcctccttcatccagagaatgcggtcgggcagccccgcatcgctgaggttcttgtagcacacgttgtggaacgtctttgaccgccagttggtacccatcccgtctatctgcacggtgatggcgttcacaaaggttgcccagctgtacaaaccccctccctgaccaaagcgcttgggcgtgtagaactcgtggggtttggcgtagatgtactcgagcaccgggtatgtcttggtcttgtcgaaatttcgcggcagggcgatgacaccgtagatgagtgtcttcccatcccggcccagtgctgaaaatctttccaatgggacccatcccttctccttgagatcgtctgatttaacttcattcagcaccaccagaagctctccagtcttagcagaccgtacggtggttcgcggtgggaggtccactcttgaggccgtgtcgatgaagaaccgcttgtctggggaccagttccagaggtgggttccgtcaccttctgtgacggcccagcattcacttccatcaaaacgaacgtggaccaggtgtatatgatagggatcttcatcctcattgaaaccatatgcggatatccaaagttcgccggtatcgtggtcgatgtgttcgaccctattcacgttccactttccgctcgtgatttggtgctgaatttggcccttctctagatcaagcatgtagaggtgattatgcccatctctttcgctagcccaaatcatcttctcggagccatcgaccttgacgacttggtagtagagcttggtcagatagtcgatgaatgtctcgctcttttcctctagtaagacacgaatcgatccatcacagttgatagccagaacacgcatacattggtgtccacgctgattgaatatgaagcggtactccccattctcgccccaaccgacattatacagattgtattggccattaaacaactcgtcctttgttagtacctcggccttcgtagtcaggttgaacagtcgaggtcggtcttctcttacgcgatcaccagcctttctgaatgccctttccttgagctggggtacaaccttgtcaccggttgcatagttaagcagccaaatcttctcgtctggaaatggagtatgctgccatgcgatcacaaacttcccatcaggcgacttgaagatcattcgttcgtcataggtaagatcttcttcagggtttttctgggcgctgtcttcttgtctgaccccctcctcagtatcatccccctgggcataccgaggaggatggtcagacagctgaaaccggttcttatcttcatcctccatccatagattgtcatcgagcacaaagatttcccctcccttgtcgtctttctcctcggcctctggctgctcttctacctgctgatcagcggcagggtcattctcgtcgctctcttcagcagcggtcttatccaaatccatctcgtccacaatgaggatatcttggtccttggggatgcgataaatgatctcagcatcgtcgggagagtcgctcttgagcttccatatatggccaggctgtgacctttggcgtttggtatcgcccggccctatgccccggtagaagacggatttgccgtcgtagtcgacccagtacatcttcagattggctcttgtgtggtttgtgaagctgaagttgacgctggagttggtcaaggtcttagattctatcatcttgcgcaagaaccccctcttccggtgggcaaacctcccatcccattcacacaggccggtcacagggctgtactcccatttccgtccttggtaggtgaaatgaacaacactgctatcgactcccacctcaatccacgtaaaagggagagagtctggatcaatctcggtcccggcatgctcggaaagttccttggccagggcctcgtggtcaaaggcaggccccgaggttttctggagaatgtcgacgtagatgaaggcgtatcttcccggcgaggtacgctggcgataccagaacgagttgccgtcgggcagccactggggagccacaaaggtctcctggagacactctccctcgatcgaaatagaggacattgtctcttattctgcgcgagtgtgccggtagtcacgacaggcaaatagggggttacaggttcatatagacggcgatatgcatgtgtatgtcactggtcggttgcactgcatcggacatacctgacagttgcattcatgaactctggggatggcccaggtggtgttagctggctccagcatcagcatgcacccgacgacggaggcgaccgtggggcggtgaggccacggttgatccgcccgaacgagccaagccatggaggaggtcgccaccagcagctaatgtgggtagggatcgcatgatgtgatgctaattttacatgttatctcgacgacggattttagtaagctaagcgacgggacagttgaattgcaacggttcaaaatgtagctctagaccaacagacctcgcactgggaacgttgttatcgttatcgcaggagcttatcttatcagcactcaatcttacataatcacaccgctttcgcagcaacgcggtcacatgccacatgcatctttgagatgcttcgctgttacagcagcgatcccccactacgatgggcaaatgatagactcggcatcgttcagagtgcagagccagatctaaagtgcagccgtgttctttacatgagttgtgaagattctagccccagccatgggcccattgctcggcacagtagctacaacggcgaatgctgctgatatgatatcatatcccagcttatgccgaggcccagagcaaagctgccgacaacaccaacaaaacatgccgccgtaacaacactccaaaccccagacaacagaccctcgtcctccaacctcatccctcctcagcactagatcctcatctccagatcatcaccacgacatagacgctagacatcgaccctcaccgcaatggagcctctcttcaccatccccatcgcggccctaccgccaaaccaccccggcggcgagatcgtctgcacagtcccccgtccgcgcacctacgtcctcaccttctcctcgcccccggacaaccgcatgaccacccccttctgccgcgccctcctctccgccctcgacgtcctcgagttcggcgaccacgagtccggcgtcgtcatcaccaccagcgccatcccgaaattctacagcaacggcctcgacctcgagcacgccgtcgccaccgacggtttctgggcgctgctctacgaagtctggcgccgcttcctaacgtgagtctcctcccccctttctccttcatcgagagagagagagagaaagctaatcgaggaacagcttcccgatgcccaccatcgccctcctcaatgggcacgccttcgccggcggcctcatgctcgccatggcccacgactaccgcctcgccccccaccccaagggcttcctctgcgtcaacgagctcctcttcggcgcgcccctcaagccccccatggccgccatattccgcaccaagctgaccccccaggtctaccggaacctcgtgctcgaggcgcggaggttcacgggggccgatgccgtcgaggcgggcatcgccgacgggctggccgacgagggggtcgagtccgccttgaagttcatcgacgcgcgggggatcgaggataaggggaagaccggggtgtacggggtgatcaaggcggagatgtacaaggacctggtgcggatgctcaagagccccgggctggaggccgaggatgcgcggttcgacgccgcgcaggagaatgagagggagaggaaggagtttggcaaggtctggtatgagcagtggcagagggagaatcagaaggccaagctgtagtagggggatgagagttgattttctgtagatgcttattctcatatgatggatttcactcagggaaagcctgtcttagatatgacctcgtcttatacttctctcttattgatggctagaaaagagacaaatgttggtttaaaaaaattggataaaaatatataatatattcaccaggtatcaaagccatggatctccaccattcatctaagggtatatcgaaaggaatgactctcgtcgtcgtccacggacgctgaagtaaaaagcatcaactcagccaatgtgtatctccccccctgtgcatgtgtgtgcgaatgtgtatgcgcctgtgtgtatatgtcgctgtataaaacaaatgggcgaaaaaaagaccaaacttccaacgcctgaaacctgttgcgcagcgatgctccccctgttgtaccccctcttcgcaccaccatctctttgacgaccaagaatgttgttgaaaatcaaaaataaacgggggtatcaaaatgaagacaccaagtccttctttccgcctcgaaccgtccccggccccgtatgctttgtactcgctttctatgttccaagtggcccgcaatccaaacaagttcccttcgctgaatatctgataaaaaaaaaaagggaagtgaaagaagagacatgaatcaagaaaaagaagaaaaagaacaccgaaaaatcaaatgcgtggagatgaggaatcatcactcctctaccactgttggttcaaccgcaactccgtttactcgtccgtctcgcgccgccgcagcatccttctccgcctggatcgctttctctctcatctgctccacttcctctcgtttgactagcttccttagagcttcgctggcctgcatcagactgtcgatactgatcgcgtgctccgtcatgtggtggttgatataggtgtacacgcctgctggtgtttggcgctgtaggagatttccctcgttgagcttgagcagggcgagggcaacttggaacagaaatgtgctgccatcgtgagtacataagacgacatcccaaacacggaacagtgcctcggcgcacaggcagtcggtgaagacggagaggaaccactggaaggtcagagcctcaagttcaatagacagggtatccaagtgtgccgacaacttgggaagcacggttgagacgtactgtcgcagcacctgctggtcagccctcgacgacatgagcgagtggtcgtagtacccctggggaaggatcttctcgatgacggaggcgaggacccagaacgcgtcctccgcggaaggcatgatgaggagaagatttgccgcgatgagattcataccttggcagtacccgacgtccttatttctgcgcgcgtacgccaccagaacctccctcagcttcttgacgcctgggcctttgcggaagaagatgttgtccgtgagtgtgcggttaatgtccatctcaatttggctgatgacaaccgggtcgtcatcctcgctcttctgagccaccaaatcctcgtaatagccaggtatacgcatcgaagcagccccagaacactcggaccaaatcttggagcggtatgcgactgggatcccaccgaggacgagactcttgaattcgttccacttggctcggccgaccttgcccttgtttccaaggttcgagatcccaatcatttcgccatcagcgacacgcgtctccggaagaatcatcgtcggtctctcgtaccgggcttccgcaactgcattggcggccgcgatcgctgcttcctcctcgcgacgacgctcggccctgaccttgcgcaagaagtcgttccaccgaggcatcttctctctctgcagcgcatcgtgaacatcgctcagctgctgcaggagaagcttgacgggctctctgtcctccttgagcaccagctcgggaatcgtctctggctgggaaggtggcgtcgtcgttccattgtccaccgccgtggttgtgctcgccgcagggacaaggccagagtcggtgggtgtaatagctggtgacttgagaggtccattcggctgcgattcagaaaccgctgcgtctgttccttcgagaacctcaagtgatgcggctccggtgctcggggtatggctgagaagctcggtcgggaaggtggcaatcttcaggtaatcctgccacctcttgttggacttgccctcctctatacttttgctgtcttcctggctgatcgggctatctgctcggcttccgctcgacacgcttcgcatggaaggaggcaagtcgtcaattagattaggagagattccagagcggccgttgatcatcatctccggacgactgcctttgcggacatgcttggccatctgcgccgcctctcgttggcgctttttccgtcgctgatcatagatgaagccgaaccgatccgtcaaatactcgctgttatcatagttcttgtagatgtgtgtcagagtcgggggttgcgactcgggagatcggatggcgtccatttccaccggcccgtagctctcctgtcgcgaggccgagtttcctggcgacgtgccaaccatggaatcccacatatccgccgcctgggctcgcgaggccgccgcctgtgcctgcgggacgggtgtggcggatcgacgcatggccatcagcgccttaggtcctccggccacagagacagttcgcgcagatcgagccgtcttgttgctcgaggccgacgcaccgcgcagagaatcggcgcgcgtagaattactgaccgcgcggcctctcgactctgcagcagcttccctgccgctgatggcacctccagcaaccagccgcagagccatgctggcgaacgagctagatggcttcctgtcggtgttgttggcggagtagaatgaagccctgctagcgcttcgtggtatctcagctgcgtttggcggcttgaaaagatcgtcttggagaataggccgcctctccaaactcgagtgggagcgaaccattgttgacgaattcacgccctcgctgagaaagctgctgccccggttcgatttcttagtcgtgccggtgccccagaagtactccttccagcctctcgtggtccccttgccgctgctttccgccggcttgccgtctttctgatcgttattgctggcattgttgccattctgattgcttgctcgaatagtcgtagatttcttgtaatccccatcctcgtcgtgtgaacgccgcgtcattgaatcctgcatcgcatcggtcatcatgtcgctcagccccgtgttgacccaattcctcgtccggccgttctttctgagctcgtcctcaaccgtgcgcaacctcgtctccagctccagattcgacagcccgcattctcggatgatcctccgaagcgccatctcgcgctcgtccgcccgcctcctcaacaacgagatctgcccgtctcgctgggcaaggtcctcggcaagctgtctcaccagccccacggcgccgtgtctcgcgaccaggcgctcgatgtgcgcattgtcggcctggtgcagcgccccgggcgccttggccagcggagcatcctcgaagagggcatccctcgcagctctcggttcggtcaagctgtcgacaatggagccgcttctagcacctcgggtgtcggtggagcgatctcggatggttgccgtcttgaaccggtcctcgtcgaatcgctcggtgacgggggactctggggagaagctggggaagctggtcagggacttgtcgctgggggcgacgctgctggccgagctgctaggctggctgaggcgcttgcgggctttggaggctcggacggtggtgctgcggtgggaggtgatggaccgatgactctgctgggattgggaccgctccagtcccgcaaccgagtccatcgtgggatctggcctctcggtctcttccttgctcactggatgcgcacccaggcgtcaaccgtctagctgttcaacctgacggcgcgcgtgtatgtcgagtgagggaggtggagggaagggaagctctcgcagggtaggctggtgctgctgagtcaactcgatggcattgcttgtaggttgaacatcaggcacagctgctgggagggataaagtgagtcgggagggtctggcgatgggcattcccttgggatcggggcctgggctgcaaggtagtgattgatgacgagatagaatgtggcgcgtgcgcacggtttctcgtccggttattgtggactgtgtgtttggtgtgccgtcggttggcgtttttgagtgtggtcaggtacctcgtcggtgggcggcagtcggtggacggcgacctgcagcgtgtcgttgatgcagccaagctggcgttgggcgggcaatggcgacgggtggaaaggcctggaaaactctgcgagacacgctcaggaacgaagcctggatcaaggggtcggcgacaagtgtcagagcagctcgcgacgctggagggacgactggcatgtcggcaatgagagatgtggatgaggtggaatccgccacagctgcctggggatacctctgcttaggctctagtaggctctccaggtgctaccctaggtcattaccagctaaatggattcatgcgctgtcactgacggctgattgccttatgcagggcccgcttcagggtttggggggttggaggggcgtcccttgggcttggtgccctgagatgggggggacctgaacggtacctgcgccgccatgtaaaggtcgtgccgcaccaaagtacctagctcgtatcgcgatccataaatacccaacagaagagtgtgggcgggccgctaattagcagcacatccattcaattaacgcgccctgaatgatgagcagcgtgcgtctcccagccctttggttcctccagaatatatatagaacgcgatatttaattttcaaattttgaaaaatcaaggagggcatcgactgctactccgcccccctttgcgagaccaccaccaatctgaggtcgaggggtaaagagaaactagggcttggccagaggggccacggtacagttggcccctcagccacaaattcctctgcttgaaattgcgacctacccaagtacgtattctcaaggaagaagttatgctatctaggaacaggcatgaggcatgacgaaagagtgagaccggtcgcacagagatgacgcgaacaccatctcatagggttgcatggagatacacacagccttctcctgaagacaccaacatctgaccgggaaaaagggtaagatgtcaaaaaaggggtagccgcagcccctttcccgtctcatcttcatctcatcaaaccaacaattcagtgtgccctccctcatgacaaagaagccgctaaaagggccctgactcgccggtgcctgagataggcctcggttcacgtggcgatgcctgcacatccgatcaggtcagacacagccagaagggccaatttcgccttgtggaggagctgtggatccatcccgtcgcgggaagacgagaagatcccgcccagcgcagcctggaaagggaaaaatgggcggcggccgaatcaggggtcatgcccttcgtgtgtcaagacgtgtcttgaaacaaagcctgggtcgtacccacgggatcacgggcaggacgcatgaactagacagatcgcttccacgatgctgcagtcgtgccgtgtttcttctcccctgctttccatcgccgcgtcactcgatgtcgttgtaagcagctctgcccctccatcccactctgcggggacgagggctccttaatctttctgtgttctctgggcagtaggagcatcatatgtgcacaatttcttcctccaccattaccctactatcgccctcgtgatccattgtagcttcattccacgttaaatttctggcaagatacctcaagatgtaataggcatatgtaggtaagcactaactgggcatacatccaatatggacatctccatgcacagccatccaaggcagacacccaagcaaaaacagtaaaaggtcaaaccgcactatatcccctctcctgctcatcatgtcaaaaacgtatcctatcctttgatttattcgccattgattatatttctgtgatataccatgtttgtctacgactccctcgacagtcttggcggcgcagcaaacgccatccggcttctgactatattgccatccagcgtgggtggccctattgaatgccgactcgactcccacagggtatccgtggatgagagacccagagcttgtggtggggttgacatcttcgagctctctcgcacaatatgcagactacctagatacgaggctctttcctatgtatgggggagtatccatgaaacggcagacatcgccatcaatgaccagccccatcgcgtcacgaaacggttggagactgcgctgagggatctgagaaaccaagacgaggagaggacgatgtggatcgatgcgctgtgcattgaccaggagaacgcaccagagaagagcgtacagattcttcgaatgaacaggatatacgaggctgcccaccgggtcatagcttggcttggtccgagcagtccagttggagacttggcggtggaaattgtgaagcaggtcggcggttccgacgatgttctcacagaggggattgatgacggcgtaaacccgatacggatggtcccaaaggtgctggatgacgctccgtcgctgagcagcatcgtctttgaaaacggggacagatgggcagctctgagatgggtctttgagaacccatggtggaagcgggcttggatcatccaggaagggacccatgcggatgacctgaggttccaagtagggcgggagaccttcggggtggacagcctgacaaacattatcagcagccgggactatcgagtggctgattacggggagctcgatatgcaggctctatgccagcctctgactgcactcatgcacgaacggagtctccggcgagatgatgatttccacgcagggttccgacagtcagcttctctaatgaacttactctccaggttcgactacagtgagtccagcgacccgagagacaagatctatgccctcctaaacttgtgcgacttggatcagctggatatcacgcccgattattcgaggtcggtgcagcaggtttaccaggacaccgccatggcaatcatacggaaggaaaagtcactcaacatcctcaacgacgtgcgtcgctcgatgaaagcttcgagtgtatcagcaagcctcccttcttgggtaccggatttctccgtgcctgcagctataagccccgttgtattgctatcgagccgacgggctggctcctttcgtgctgcaggtgatacagaagccgactacacgtatgcggatgaaaatggcggcccgttggggcaactgcaggtctcgggatataatttcgaccttattacggaaacctttgcttgtccaccagaagagtcctttcaagacgactcgtgggcgagcattgtccgtgagtgggctttaaccgcacggcatggtgcgtatcccacgggtgggagctatgaagacgcaatctgccgtacacttctccaagatcgaatacggtctgccaaggagcggatcactgatgatgactttgcacgactgaagaagtccttctctgcttgggtttttaacgaaaacatgaacgtccccgctctgaaggaagaaagaaaggcgaaaggctcttctcacgatcatgccgaggagcctcagacgctcgaagaacgttggaaacgatcagtgtatagttccatcaccgcggataaggatagttcagagttcaagaagttcctgattcaaaaatgggagagggaggacactcgccgccaggaacgggccgagctggcggagagattcctagagcgctcttttcttgatcacgccaagcctcgtttgatgggctggaagatggcatattcggaaaagggttatgtggctttggtcccctttgatgcccaggtgggagacatgttggttgtatttgcaggcttgagcgtcccggtggtggttcgcaggctggagccaggagaggacaagtttctcagcacctgctatgtacacgggattatggacgctgatgcgagggttatagaaggcctcgaggagaagaatgaaatatttgcgttggtatgagttgaacgggaagttgaggcctgaaagatggcgacgtccagttgcatcttacactggtgcaaccccccaccaaccaaaagatccacggatggatttctgagcggacgactcccaagtgatgcctaaatatccaagtcaggatgggtgacacgaccctgatgtcttgccgctgccgggaccggtgggaatgcaaacgcggcttttggtgccatccatgtggcccaatagctccgtttaaactgaaatgtcctcattccagccgtggtgtaggaaaaatactctcatttctccagcctattttagatttattcttactgctccctcgatgttgctattctcacgtttaccatacggcgtattacctcaggacgccaccctcagcttcaacataaaagcgtagacctgatatccgttaattagtgatgatagccagatcaataagggcagaaatagagtaccatttttggtatatttatagtttaattcagcgtctgttaattacccttatgttcacgtcgtatgcaatatggtcgacctcaagtgtcacttctatgtcatctggttcaactaccaaaacatgggggggagtggcaagttcatctactcggcggcaatttcacaagcaagtcatacttgccttggtagggcgagacaatcataatctcatgcaaacacgagatcaagcaaagtgacaacgtgatatctgcatcaggcagaagacagacgtttgtccggatatcgcggatggcatacaacagcacacaaaacttctcaccttcttcattaagttacgatgaccaatcaccacccgaagcgaagcatctcatttaagcaatccgacatcgggaaacagagcccatggggtgaagagcctgacaacctggggctcgcctcgcttctccacggggaggcgagaagactcgtcccaccacaaccccatgccgccaatgcggcctcctgccctatgtttaggggatcaacaaagtttcaaggtatataccgttccgcacgctggggtgaagacgcggaatgggagtaagccgcggctgcccggtaccccagaatccaccatagaaggttaagccgaggcgtcgctggcgtcgagatgcgcagatgagacgccgcggaggtgggagagtggtgtgaggaggccgtggagaggctgacaggtcgcaagcttgtacgtaatacgagcgcatcgtcaatctggggagagggatagagacagcgagcttggtgaagcggcctccagacaaggccaagaagagacggtagccaggcaccgaggcgccgagacttggcgcccgggccttggctgcagccgcaaaagaccccggaccagccgtcccgagcagctcaaccggagactggcattaggtaaaatggaccgactcttaggtaaagaaatccacccgagacggatccgcggcatgaaaagttatgagcacagcaataagcagtttctgagagattgagtcagcagaagaagttttttttctcccgtcccaggtaagggtgtggtggtttgtggcagtgtcgccatgttgaagactgcttgataaacctccaaagggagacccgaagaggcgaaacaaaactccgaaacgcgaaatggatggcaacagctcatcagagagagaaacatggttggtggagctcccgcaaggcaatctcaaaacagctagaagtgctagtgacatcctccatggagacaagcgggaggcgacaaacccaagcctcctacgtctcaagagaaaactctgataggtagaagcagcgtggaagcctcatggaacacgccaagatccacattaatcgacccaactctccactcccgtgttcaaaaactgcctcccaggtaccattcacggctttgttctttgggcacgagccaagggtcagacggccgagaggtttcctggaccctgtaatactttgcccgttatttttctcatccgacttcggcctggtttccccatgtaatataaaggctcaatgcaaatggaaccgctatatagagttctgttgctcccaaagtagggtgaacgtaaaaacccttctctaccctcttgctctcctcccttctcattagtttcttctccgtgtctgacccttgattgtcaagtttgggcaggacataaaagtaagagacctccgtggggaagaagaaaaaaagcgacatggctccccgcaataacgatgatgccatcacggcagcggagaggaaagaaaccaagaagcaggccagcaccatgctgatagatgccgccgccgacagggaacttgcggctggggaagtcaccgaatgggaaaagcagaagatcctcgccggcaatgccaaattccaccagctcggatggcaccgtcttgccttgatcctgattgtcgaggccgtcgcgctcggcgccctctcgctcccgtactgcttctccatcttgggcatgttcgcgggcaccgtcgtctccgtcttcttcggcttcctcgccatctacgccggacacaacgtcggtgctctcaaagtcaagtatcctgagatcaagagttacgccgatgcggggcgggtgatgtttggccgctggggctacgagcttgtctacgtcatctttttcctcgagctcatcttcgtctccggttcgcattgtttgacaggcacgattgccttcaaggacttgaccaacaatggcgcctgcagcctggtgtttggcatcgtatccgccatcatcctcttcctcgtgtcggtccctccctcgtttgctgagatgaccatcctcggctacatcgatttcatctccatcatcgccgccatcggtatcacaatcatcgctaccggcgtccaggcgtctgagtcggtgggaggaatgagctccgtcgactggtcctggaagcccaaggacggagtgactgcccacgaggttttcgtcgccgttgtcaacatcatcctcgcatacaccttcactctgtgccagttctccttcatggacgagatgcacaccccgaccgactattccaagggcgtctggacagctggaatcatcgagatcttcatctataccctcaccggcaccctcgtctacgctttcgtcggcgtcgacgtcgagtcgcctgccctgctctcgggcgggcccctcatcagcaagatcgcgtttggtgttgcactccccgtcattttcatcagtggtgccatcatcacccagacggctgcacgactcatccacggccgcatctatgcgaaccgcgtagagcgatatgtcaacacgacgcgcggctggatcacctggctcctcactgttctgatcattgtcattgtcggctgggtcatcgcagaggcaattccctttttcagcaacctggtcgccttgatctcgagtctgttcaactctggctttgcgctctacctacccggactcatgtggttcacgctgttgcgcgaaggcccacttctaagccgcaagaacttggtgcccctgtttattaacggattcatgattgcggctggcatggtcgttttggttggtggaacgtgggcttccatcaagagcatcgtaagtactataccatgtcgcctctctgtctcattcccctctttcccctccaaagtgagacaattccgaatagcgtgctaattattgtcattcccaggtcgacgactataatgcgggaactgtcggggggtcgttcacatgctcgtaaagctgaagattgtgttgcaggatagaagtggactttgtagcattagcgaatcatctcaaattaataatactccaatcgcgatttttgtccttgttacatgtttcatgatgagtccagttggtgcccagctgcgtacaaaggaatgtgggcttcgatgtcctcgagccagcctatcacagtcaagggcggaagacagagtcaagattgacagtggtgggagcgagtgatgggtgagttccaatgagttccaagcatgagagcaaaatatggggcaggggcacttgctccagctccatggagggtcaaaactcaaggctgacagggggagctgcaaaagagagcacacgaccagcgagctgagctaaagcagccagtcatcagcgcgtcctggaccaatggacgaggcaaggaaaacattgcttttgcttgagccctgcccaatttggttcagaagaccacacagagagggcaaaggtcgctggaaaaaaacgctgatggtggtatctggcgggacacgtctgcgtgggctcgagcgatgacgacgacggcgacgacgacttgacaggtcgtatccagcaagtctcgttgtgccctgcccaggctaatcgagacggctctggaatgaggcgccgacaggcaccgtaggactgtgtgtgttattctgggctcgcctggcaagacggccacgtgcccccaaggacacctccagctgctaatcagaggctggcactcagcaccgtaagtcggccgatagcgtcgcattcgagtcctgcagctttgtcgggtgcgaccatgaccgccaggaagacgaaaaccgggcggctgccgagtgacgggcctgatggcctgcatacacgaccgcctatagcaaggccagctgccggcaatagcagcacagtggaggtaaggcgtcgggaatgtttcgctgctgcaaacagcctcgaaccccagatgatgcgatgtgtgcgtgagatgggggcggctgcctgaatcgtgaggccaccactctgcccctccaaaccccgctgtctgccttatgtgtttcctgcttcaaacatcagatgtcagtcgaactccgtagatcgccaaacatccccgccagtctgtctttctttcaactcgagccaagtcgagtctgcgataccctcctcccagcgcgcgccctttgtttgtccgtcgctaccttccaggcacacatcgtctgtccttctatccatcatggtcggtgctcgccccccgcagctctattgttctctctgtcatgcttgttcctgtcctctgccttacgcaactcccttgtccattccagcccttttttgcagccgcattttttttggccgccaagttacccctcccccaccaacaaaaaatcagaccgtcgcggtgcccgccattatgagggcccccgaacaatggaagccagcatcaccaccagctaaacacgttgctaacattctcgtcgccatagtctggactcacccagcaagaaatcgacgactacaaggaggctttccagctcttcgtaagataaccctccaccctactatagcttcatgcctcgtgtgaggacatccgctaagatctcgccttccgtgaacaataggacaaggatggcgatggttagtaccaagttcccacctaccatcaccccctacgcaacctcgatcgtccatacgcacaagcgtccgccgccgtcacctgaggtctccaactcgaggcgaactgaacattagccgaattgacgtcccccaacaacaccatattaacgatgccgtgtcttaggtgagatcaccaccgccgagatcggcgagatcatgaagtctctcggcctcaacccctccgaggacgagctcgaggatatcctcaacgaggtcgacgtcgacaagaacggctccgtcgacttcaatggttcgttcccagctccctcccagcgcccttcccagcgccctttccagacctgtcaggctgaccgcaagcgatagagttcgtcgccatgatgtcgcgaaagcaccagagcgccgaccccgaccaggagctccgcgacgccttcaacgtctttgaccgcgacggcaccggcaccatctcccgcgacgagctccgcaacgtcatgaagtccattggcgagcacctcacagaggacgagctcgacgagatgctcaagctcgccgacgagaacggcgacggacagatcgactgtaagtcgtcctccttccgctatctacatccatacacagctaaccaagctcactccgccagacgaggaattcgtcaagatcatgggccacggcggccattgagtcggtcttgtctcacgcgactgagttttgatgggtttttctcgtcctgccattaccccccacctcacagatccccctctcgccccgtttttattttctctatttatttcctggatgaagcgcaaggaatgaagatatgattccatttattctggattattaccgtatggcattgctggttaggctatagcgaacgggctcgttaataaatctcgccaacatgatcatcaaagcattttcaccctgaaaccacaaacacaaaaaaggaacgaaaacgaagtcccaaactgaaacaaaaaaaaaattcaatggatatgtggaaaggacatcatcccccgcacttactacccaccttgatgagaaccgcacacacagataattatgagacgatgataagagcatgaaggagcatttattattcataaaacatcaagccaattctcccggcaatatcccccccattttggttctagtcgtacatgccccgttgttcccaaaagcgaaaagaaaagaaaaaaaagcgcctggccctgtaaaccgaaatccaaatccgtattgcttctcaggcgatcccttcgcctccatccttctccgcctgaatcaaaatctggacaatgtcaatgccacacataaactccaacaaaaccaatgaacaaccctttccagggaagaacaacagtgaaagagaagaaagaaaaaaaaaaacagcatgtaaccattaactccaagccccttatgtacgtacgccgctcaatgcatcattaagtgtgaagaagaaacaaaaatcgtgaggtgaggccaggttgcctctccatattcctcctcgcgagtaagaagtgtgcgtccaggtagacactttacatgccaacggcccacgcctatattcaggccttcgcgggctcctccacagactctacttcctgcgctggcgctttgccctcgtcaagagatggaagcagaccctcggagagcagagtctcgaggaccgcgtccttttgtagaatagtttgcctctcgacggggagcccatccagcgttcggagcttcctgcagctcgttgtgaacactacctggtgcagccgacggcgaagcttggttgtttcgtccagacgcccagcgtacagctcatcccttgccgtgtcgccgtctgggaggacaaagggatccacaggccccttgcgttccttacacacaaggacctgtatcggggcgtagaatccgagtgtcaccgggttatctctgacatcaagctgtcgcagatgcgggaaatccgtcaacagctctgtcaccacggtcgagtctgccagtctgttgccagcacagagcagcttcttcagccgcgggatgaacttcaatggggtcaaattggcgatagcgttgaagttgaggttaagggtgcgcagattcggcataagttggccgagtttctcaggcaaagtttgaagtccgcaattcgccaattccaggagttgcaaattcaagaaatctacacagggttcgaacgcgcccaggaagtttccagacaggaacaactttcggacttcatatgcagctgcgaggaagctcaaatctagagttccgttaccacgctgctctcgaagggaaagactatctagccgccggcacttgctgaagccactcaggctagtcaggaggtttcgatcggcgtagaggctctgcagagacggcagatttccaacatcaaggctggtcaggtcattgtcgctcacatccagctgtcgcaacgctccaatgcacctcgagaagttcagagtctcgagttgatttttaccgagcttcaatcgggtgagcgacggcagaagctcaatctttcggatcgagcgcagtttgttgcctgtcaagtcgagatctgtgaggcgctcaagtctaagcgtcgtgaagtcaatatcctcgataagattgtctcgggccgttaatgagagcaagccatcatggtaatcaagatcatccagtgaagtcagctggttgttgtcagccttgacgcttcgaagatggacaagattcttcaaagccgacagactcttgatctcattgccagatacatcgacgtattgcagattccacagatggtcccaggaggtcagctcagtgagcatattctgtgagacttttaattgtctcacagtagatggcactccgtccaaatgagcaagcgtgtttccagaagcatcgagagtcaccaccttgccgcagaactcgtccagcatgtgaagactgctgagattttttccgctgagattgaggtctgcaaggtcttcccagtatggctcatgtggctcaacctggctaagcttgtccacgaggttacgtatcgacatggtcaagaccttcttagcaccatctccagtttccatgtgccgtcgtcccatgacataactgacttcaaatccaaaggactggtcggaattattgaccgtaaactcagaaagtggactcagagacagcttcccgacattttgcccaataatggcgctatcatcggcaataaaggaaagggcttgattccctggagtatggttcataatgaaactcaggcttgtacggcgcgcattgggtgtcttatggctgaccatactggtctctccaatcacgctgagctgctgatcatgaaaaggcagttcgacggtactatcctcgtcctgctcgtcaatccgggacactggtcggggaataaaatcggaatcaccatcagaaagctggcggggtggcattcgggcatttccgcggccatttgcctgcgctggatgcttcagggctgacttgttcatggatttttgcccctgagctcgcatcgccgcgacggtcgctttgtgatccagcgccaccggggtatcctcgtcgtcctcgtcgtcctggctatcccgctcctcagaatgtgcctcgtggataaatgatgctaccggtgatgaaaaggaaatcgtcatatggcggcggttcgcagcctgagattcaggcggtgtttcttggctgtcagccactgggggaggcagctcttcactgagccccaggtctgagccggggtggctattgatgctaacgctccgaagttggcgtgatgccgcaagagagccatttggagacaggtgcccatcaggtgagaaagtcataaatgccctgggtggggggccatttgcgagtggactgctgggtgattcacaaatgtcgatgttcagagctccctctcccttgcgggttgtcgctagccggagattctgcagttccttggtcaaatccactgagaggtctgggatgctggcaaacgggtcgtcctcgctgccatctgatggcaagacgttgacttcttgctctcgtgtgccatctttgctctttacccaggtgttgctgttcttgtccaatcgcatgctcccaaccttatctggaatgaggtgggaaacactctcaggcatgattgttcttcgtgactcggagcctcttgacgacgcagtagggtatgagcggtgcgtgccacggcccgaagaatccgaagggaattcccttgtaggactagccgtcgcggcggccatcgctggattcatggtgatgcggatattgggaatgtcgctaataacattttcaccatccgtagccattgggcttctgagccagccattagctctctccagcgatgacttcccgcttggccgatcagcattagaatcctcaaggacaaaacccatagaacgcagagaggatagtacatcccccatatcactaatctcctggtactttttcaaccggttgagaagctcgggatcatcatgacggagtggtgttctagagactgtgggcttcccttcgcgactgggaggacgagagaaaggctctgttgtcgattctgagcgcacatcatcagacggggccgggcttgattccctgttaaactctgcttcagactcctccaagctagagagcccatggggccgcacttggtttcgaatcatggccatgatctgtgctgcctggtcaacgaaatcttgcgttctaattgaaggcttcctgtcagtagccagagactcctcagcctgtaagcttccatccttccaatgggttggattcggcgccgtctttggtctgagaacagattcttcgccaacaacctcacccagcggggcccttccactggaaattcgcggcctcaaaattgggcgtgtagctagaactcggggatcagccagctcaaatacgctgtgtagagcttcctgactacattcgccttggctcggctgtcgctggctcgggccaaggtcgatgccagcaaggttttctcgcccaaaagcgatatctgatcgatgaagagttctcctgcgtttgggtgtggggtccttcactggggatgtccttggccgcttgccttcggagtcaacatcccgctttggactgccgaggttctccaaagtcatctgtgggtgggtggcaggttgtcgtctctggctcgatgtggaggtgacccgcgagtgtgtgccagctgagactgacctagatttatcccgtctccgacgaacgatgatctctgagccatcgtcaggcgatgactcgcgcaaaccttgagaggtatatgatggccgcgatgggaatggcttaggagagatgttctccttgttcgaaactcctgtttcgttgcccaaagtaaactcgtaatcttttaatgtgccagctccaaactcgctgatcaaatgggattcatccagtggtggcaagtctggggaacccggagatcttgggtgttcgtcgtcctgatcaaaggaaagctgtctctcacgtaacggagcgggactgattgagttcttcgatggcgtagctgaggtgccctcctcaaattggctgatgcgccgaagcagtgtttggttggtaaatgtgtcatagggaccgaagagcttaagtggactgccgccagagttcgctggtctattggaagccttttcagggcttggaaatggtgcccgcggtatcgaaggactggccccaaagccacggttgaagttcattgtgtcgtttcgaatcgtcgggaactgttttggtgtgctggcttgcagagattcctcgggcagcatttcggagctatcaccgcccaagcccatgtcaggactcaacccacggtagagaaaagatccatcctgggacctgccacctctgcggcaattgatgtttgctgcctgttgggccaactcgttggtatcaacttcctctccatcgaaagcctcttcaagattgatttcagggtccagcagcatttggttaatccgcaaacgctccagcttttgctttaattgattggcaggaacttcaataggtgtaaattcgaccgttcccgcttcatcgctatgttttccaataagaatagggctaaagtcctcgtgcctgatctcactttgcccgctaactttccttgagttgattccggcatctgaaggcacactgagaatgctctggtcttggttgagcattcctcgttggcccgtggtcatgcttggaggagtgcttgttggcgccgtgtcctcaatgttgagcctatattgaatacctcgcattgatctcctagggctcgggcttggggtaacctcattcggcatttcatggtcctcctcttcgaaagtatcgacttcgtttgccaggtcaatgctgcttcggcggtggcagagtggggggctagacggcattgtagactcgagatgatgttcctgtgactcgttgatctcctcggggaggtcctcttcaacgtcgactgggggtttgaacatgtcttgaagaccaacggcagctgagctaaacagatcgcgctgttccccatactgcatgtcacccttgagcagacgccgcttccactcaggcgtttgtctaatgctcctccctgatggtgatcggtgaactgtgttatgcacgaccgatccattagaggagccaggtgccgactggctctcgtcgtcgttgcttataaacgctttgatctcatggcgcgctttcatcgatagccgttgcatcgatatgttgatgtcgttgacactgcgctcgcccagaatatagctgtcgccatgctcgttcgcaggtgcaagattcggtatgggatccaacgtcttacggggtatccgacttgggtattcatgtgccttgtttttcttgtccgaggaggggagctgtgcgatagagttgacggatccgggctgggaaacccaatcctctgataaggaatccagccaggcgtgttccatagctgcgacgccagagaggctaagatcgctcgagaatgttcagtcggcagtgatgcgcatgtctaatcgaggtcgcggttgagggtatgcggggtcacgaattgcgccagagtgggaagagcgatggcggagacggaaaggcgaaatgtagtgtggtgtgttagacgataaatagtaaaacgattgaatcgaaaataaaatgtcgagatagatgaatgctgctggcgaacgctgctggttagtacagagaatggtatggagctggaagtttgtagttggagggtcagccacgagaggaatcgcgtttcgaaaccagggcttgtgcctcatgagcagatagacaaggcgatcggaggtaaacaaagcagggataggctagtggtgcgattagaaaggccgttgccctgccaacagatctgcagcacatgagacactgcgggtcacgtggccggccaggttgcatccagggaccagagcagcgtgcatggtggctgcaggtaactaatcttgatcttgaaatgtccatgaaatcggattacacgctttctgacattaacaaacaagctgtaatttattatcttatgatgccataggtagtcaagcgatggccaaatatcttagcgcattatccgtccttagctcccgccaattcaccaaggtactaagtactagtccaaccactttgcgcgccgtcacgtgaaaacgcgagcgcgtcgccctagacgcgattcaccagctccttcctcgagggtaggtaagtccaagtaaggttcagattagattgcacttggcacatttactcgatcctcaaactcctcgacagagacaacgtgttccacgccaacattcctccctccatcactgtgcggtctgatttgtttctttcttgtcccactggctgtgtatcaatgttgtgtgtgcgacgattttcccaccatgtttagtgagcatgcggatcggcatcaggacggagcagaaaacctctacagccagtcaatatgtcggccggacgaagtattgtacgaaggatccgatgacgaatattacgagagccctgaaattcggagagcacggctttctgctgctgcaaagcggttccttgacggtgacgacactttcatcctatcatcagcactaaaagggccgtttgaagggagctcaggatgggcgaacccgtggcgatcaaaacggtcgaaaaacgcccaagtcgagtcgaatgccacgccatcccatgctaggagtcgacgaacatcccggccatcccaaacgcagaacgagacacaaccaaacagtaccctcgagtgccatttactgagccctgagagccttaagcagggtcccttggccacccataattttatggaagaagatgaggttgccagggtacaagattggagaactacgatcccttccgttgacctggaaaatgatacattctgggctggaaatccgacggcatcggcctcacctcaaactcgttccaggaagaggaagctagcccaagagttggactggctcaagggaacaaacaaacgaccgagagccgacggagagaatgacaccgctcctctacgtaggtcgagaaggacgagaagttctcccaatttatcaaccagacgggcaaccggtgctgcgtcaccgcctcgtccatcacaaaccacccaatcatctagttccaagcgacgctcccttaaggctcgggcggcatttgatgctgaagacgaactcacgagctcagtgaacgcaccactcaagagcactacgcgccggaaaagcagtcccataaagcgtgtttcctctcacattgtacttaaatctacacagggaagctcctcatactctgaggatgagcttgccaacgaagatgaagctgacctcaaggccgctgctactctttcatctccagtctccaacaaaggatggccgcgaccagtggagcaaaaactcgaacgagagagtaaacatactgtcagccccaggcgttccaagagactatctatgtcaccaaaacaaggagatgaattactagaccaggattcaaccagccaaggacttaaaaactctccagggacggaagcccagaaagacgacagctttggtgtggaaaagaccacaaagacaaccaatgaaatcgagagccaactctcatctttaagatccgattcggacttgaatgatgccgagtcgctctcgagctcagcttcggaccatgaagaatgtaatgaggtaccgacagatgccgatcatgtcacacaagacaccattcaatccaaaattgtcagcaatactggagatgtggatatgacctccaattcctctgcgtccgatacctcggacgtagatatggatgacgcttcggatatccagcaaacaccacatatcattggcgttgcaatcaaagatttacaggcacgctcacaggctgacgacgattccgtggctagttccagtgccacctcctgctccgaggaatctgatttcagtgagggagaatctgaggtcggagcactaactaccgtctctgattcacaggcacaggagaggcctattgaggtccaaaatggaccaactgcgacaactaaacctcaagttgaatctgtccaagatcttcccatcgccacagcatcaatcacctcctcggagcagctatcttatgctccagataaggaaattgaggctgctcccaacccgatcggagagaccataagaggagaagaaatcccctccgtcgaaaattctaactctgacgagtccagccagaccgataatagcggtgaggggctcatagacaaaaccccagtctcacaggtggcagtcccttgcatggaggcgaacaccagcattcacatgccaacaactcctacgactgatcaggtcgtgtttacccagggcggtggggaaattgatgtaccggggactggggcccctgacgaccaactcaagatcaacacaccgcaaagcccatggtcaaaatctcaatactctcaattctttgccacggctccttcaggatcaccaatcggtgactctgagaagctcgatcctgaaccttcagccagtcttcaatcaccctgggtagcgagtcaggatagcttccaaaaagctgccggattgagtgaactcgagagcgacagattctccccaacctcgaagtcccgacttggacgacagtctacaccagagagcgacgtgcctttccaaccgttctctgcatttatgaccccatcacccgagcgcagagctcgtagaatagcacgcgccggtcccaggttttcaagtggaggtctccctagctctcaagccctcgcatctgcaatgaagaacccgtggggcagtggtaaagccaatcgacgggtttcttgggcacctctcccccacgaagctacggccgacatagactcagcctcttccgaaaacgaccaattatcgcctagccaaagacaacggccatcttcgccaccgccccaagtctcaatcgcggatgtgtcacaggaggcgggcgaggataggttccgcgaccacttcgacgccgttgcccgtcgagcagccgagcacccacagcgcattctcccgaccgagtcccagcagaccgctggaagcccagacgcctgcgcaatggcggagaacttcattgcctttaacgaaaataaaacggtaggatccgccatgcatccccagaaaggggattcggctactcctcgatcacaaagcggtttcgggacagatatggacaacgatgatcttttagaagatgttttcaacgatattcaggagcttctacagccgtggaatctagacgctgagctcgaacaggcacgcaaggaatcaggaaacgacccagtcccagtggacatttgggccctttagaacgccacacagtggtaaatgcatcatcttatggagtttggacttggagcatgttctttcttatatttagactatggggtgtttgggagattatcttgtggcaatgagttttattactgttggtggactgggtgcgccggatgcgcgtttattgttacgacggggagttgatacacatatcctcgaattgtcagtttttatcgaattaactagcccgatataccacatatgaatgagacagcgatgtattagcaattcttttggtcgtggccttcttccatcatgactaccctagacaacacattgtttttgtgtactcagtgtactcagaggaagaactagagtggcattactgaaaattagaacatgaagagcgtcaatgattgcatctttggtttagaaaaaaaaatccatatcctgatcagtactcttggtgcaataacggcggcacaacaagtaagtctagcggcatgaggcgaatctatcctcagacatactagcaagacggataagccatctactatcctctgaggctttacatgcaatgaccagtattacctttcgatgccaagcctccctgccccgacacgaaggcatcagtgaaatgtactcctcccctcattggacggccttgaccaccttgagatgatcatggtggatacgcgtcatcaattaatgcagcatcacaagcggtctggctctggtctcttccaccactggccaagacgacatggcacgttggtcacaccctcattcgacagcgccaaggctacggatctgtgggaactccgaaagtgcttatcccttcttcctcccggggatctagatgctcccctggttctttccatgtgttatcatagcaacagccggtgccagggacatcagaggctcatgcgggatcccggtcccggctaagaaactcgctcgtcccaacaatgtgtcacgatcagaccaaacgacggcggtccggaagggaagcacgaaggaggaagactcttcctctctcgtgtgcacactgacgctggccgcgccgcccggatttccccacccccttgcgcaacaccgtcgccatgtgtgcagtagtttgtccagccactaccgatcacggcccatcgagattcacgttcggcttccagcgaggcctagtcgcgctttcttttctttttcctcgtgtacatagtgtgtctggcagggtcaatttttttttaccgagtcaagccaatttctcttacatttgtgtttcctggcgggcagtccacgtgctcccattgaggtctctggttgtgcgatgaactctggcattccctcaaatccacactgatgtctaccatgagtcaaggcggccacgcatcaaggttcttgagacgagacctctcgatgcgagtgagaaaaggggaaatgaagctaactctggaggggcacgagggcaaacgcaaaaagaacctacacgcactcactcacacacagtgaagcggaagactcaagcgagatgacgaaatattgtcgcacttgaagtgtcacacgggtcgctccagaaccaagacatggacacttattcgggttcgccacccaactctgtcacatttaacattttttttattgttccagggtctcgaaaattccagatggaaactggccggccggcaccgagggccaggcaagtgggcgacaggagaaatgagacacctaccggaagagtggttattaatcgactacttttctgtaatgaatagagaaattcagtagtataaaaataaaataaagtaataatatatacggtattatctctgaagtatgtattattgatactcaataatctgataatactggtcgcagacaaaagaataagcagcttaatgtttgagtgtctcaatttcaatgtcacccacttgccaggatacactcaccgtcgccagactgggggtgaaacaagcaagtcatggaagggcatacttcgggagctttggcgacagtcttgtttcattggagtgcatcgctcaacatgctcgtctggtgtcattccccattgaccagaccgtattaccgtataatttcgcaaaattcgctgaaaaggggccccacattgcacccttgttcgtatccacaccaaatacacccttgcaaacctgcaaatgcaaacaggctttccatccaagatcgcgcccgcccgggccctccaaaacgcgtcggtcaacagctaattcattaggtcaatagctagcccaagaggccagggctgcttccacgaacctagggatccttttttgaagctattcgcgatgcctcctttgcagccgagagatgtcaaccttgcggttacacctgcgaaacgtcgtccgggcaggaaacgcaaaagccttgaagatcgaatttacagcccacccaagcctgtccgacgcgttgaacgaagctatccggaccatcagaagatcaaggttcttatgtttcttcatcatcatcgtgttttcgtccgacgggtcaaaagcccggattactatcgccctccttcacagcaagaagcagccgatttcttccagatcccgcaacgcacgattggacagtgggttcgtcagaaggatgagattatctctcaatacggtcaaaaagcaagcctacggcagaggaaccacacgggagacataaatacgcctgttttacagcatattcccgtccgacgaaagagcccgggccgctgtgcagcctgcagaggtgtccattggcatgagcctacgaaaacggctttcaaagaggtcagcgggaataggagggtgccgcagtcaagatccggctgtcagcaatgtaatgttcctctttgtcactcagaccgttgctggtacttctatcataggctaaattaatatgcaaaataatgtatctgatactgctaggtttttgggccaatcagacccctgtaaggtacaaagtgtagccttcgatgcaccaaggagattgtgcatgtgagcttgttaacatcatcactgattggcccagacaaaggtgaaaaatagccgcttggttactaacttaatgggtcgagcagctttcctgatgtcagagccccaccttggctccgaagctcaccgcctgccggatttagcatgattgctgtccctgctgatgaaagagctgaaaatggctacttgtgacgaggagggtcacaagctacggggcacgcgtttgggggcaacgtaagagttattgagatacttattcctctagctaaataagatagaaaatgtaacctatttatgtacatatgtaaaattcgctgatgagggacatcaagtgaaaggtccacgcatccacccttgctcacactatccttcctacatcctttcattcccctacgttatctcagcacttattggacagagttgctgcgtcccacatagtttcatcctatcgtcagagcacagcattggtcctaaacacatgcccttagctcgtgatctttatcacacgattatttgcacaacaagaaaacagtaaacgtcctttcggtgcactttcccagctctttatctgcttttccgtaacatacttgtgatcacgccctttcctgtatctacctggccgacagtctcaaagtcgaactttaaatacagatggacgcctgctggcgatgccagcacatacatatgtctattgtgtcggtctacctcttgacaaatccatttcatcatgaatgaaccaactccttggttctggtgttccgtatgtacagacatgaaggttaaacctatttgaagtttagagatcagcgctgcgagttaaacatatgctacttacgcaatacattatcaaggttactgaggatgcgtttccgctcattcatcagagcattagataccttcagccacgcagctatatcaagtgtatctggaaggtaatttccttctttgaaactctttttcagtcgatctggcttagtgcaattggccgtgttttccaatacccagccagcaaacccgagcggtgtaccatcgattgcgcaggccttgcaaagatgcgtgccactgtagaaggcacgctccatgctaacaatataccatttcacaacattctcacgctcctcatctcgcaggatggcgttaaacatgattcggtacaacgggccatcctgcattgcagggtagtcgatacttcggacaagcaaagcgatgtctgaggactggacatcggagagagagagcgccatatcgttcgtgcctatattacacattggtgtctcaagaacaagggaagtcgtattacaaggtatgttcaacacacttaaccccgctgtgtcacatattagcccaatttttcgagtgaataatgtcacgtggggcatagtcacctgatttcaagttcgaggctgataatagaatgataattgaaaaactgataaaacaaaacttttcacaacagcgagaacaaatttttgacagctaccccaaacagcactcgaacgtcccttcgacgggtctattgaatagcctgaagcctaacgcatcgcccagtgcgtattggaccatggcgacctcgtggccccaagaggtggcatggcccgacggattccgcgagcacgccacgcaactcagcagatacctcaaagatgccctcctgtacatcgaacgcgtgaaagaccaacccgtccccaatgacctggctaagatgatggctatgagcgcactatctttcgttaatataatccacaacatccccgacctcggtaccgtgcacgacgcgcttcaaatggcccgaaccgaatcgaaaatcacggcggaaaatacgatgcaggccctcaacgacatcaaaatggaagtcaaaaaggcagcaaacacgagccagcaggcgttagagagaatccatgacaaccacgaaacacaaaacgagatgaaagcagcagccagagaaacgaccgacatcggcaaaagggttatgacaatggtgagggagatgaagaataccgaacagcacaatcaaccgagccccctacggacctacgcatcggtagcggcggggaacgggctagccacaagcatacacaatccattgaaccaactcaaagcgccacccgcgcaaatgctccgtgagattataataaacatccgcaacccactcaccgtagcgagcctacgggcgatgaacccgcgtagtctaaaggcacacgtagatcgtgctatagaacaaagcggcaacgagcacattgagaagatcaagactgcgtccactaaccagctgaagagcggcgatcttagtatcaagacagctacggcctccgacatggaggtgctccgacagttcgccgaggattgggagcaccgggtcggcaacggggnctcctcaagacagttctatcgcggaaatatgattatcagagggctctttgtgaggatccaaagatcattcgcccttggtttgaccttgttcgcaactttacggctaagtatggcattccggaagatgatatctacaattttgacgagactggctttatgatgggccagattcaaccacatatggtcgttacacgctcagatcgggttggaaagcctcatttggctcagcctggtaatcgggaatgggctacagcaatccaggccattaatgcattgggctgggcagttccgccatacttgattgttaagggccaatatcatcttgcatcttggactcacgacaactatttaccactcgactggcggattgcagtcagtaaaaatagatagactataaataagattggtctagattggattaaacactttaatcaatctacaaagacgcgtgtaaagggcaaatatcgccttcttattctggatagccatgagagccaccactcaatggaatttgagtcctattatcgagataatgacattaagactctctgtatgcctcctcactcctctcatattcttcagccacttgatgtaggcgtttttggcctattaaaaacagcctatggccgccaaattgagcatcttataaaggcacagattacctatattacaaaggaagatttcttccctgtatttctagaagcatttaatacctctataacccaggaaaatatcnnnnnnnnnnnnnnnnnnnnnnnnnnnnnnnnnnnnnnnnnnnnnnnnnnacctctataacccaggaaaatatccaggggggttttagaggagctggacttattcctttagatgcaaaaagggttcttttaaagctggatgtacgattattaacactaacaccgccaggcacccctctggaactgcctacagtttaggaatcaaagacgccaaacaacccaattgaggctacttcacagtctgaatacttgcgaaatagggtaatacagcatcagaacagctctccatctccaattcttgatagaatcaataagattgcaaagggtacacagcgtgttatgcatgaggtagcaatcctacgtgaggaggttgctactcttcggaaggcaaatgaggtactaagcaagcgccggagagctaaaaaaacacgtctacaacaaggaggatccttaaatatacaggaatcacaggatatagtagctcaacaggaggttaatagtcagattacccaggaagagcacttgggtcggggtcggaagctacgggataagacccgtgttcgacgatgtggtatatgtggtaagacaggacataatgcacggacttgtcagatagttgtaagtatgctaggagaggtttatcttgatatggaactgctctatgctaatgactgacagctctctaaattcattagaggcagtcatcctagatctacatctggtcgcgctaggacgaccaattccgaaaaacttgtgttgtaggacgagatagaagctagacatttatggctccgtccatatagataaccgtaatactgctcagcgattttactatacttcccaaaatggaatannnnnnnnnnnnnnnnnnnnagtatgagtttcacacaaaccagatgtaactaaattctaactaacgctcttaatgccagtatcactgttgagggtaaccgacatcgccaggcaaccaggacataaagtagtagagatataattgttcaaccctcgataaaagcattaggatctctgtctattcttttccatctaagatgccatagcaacgcctaaagtgaagccataagagcggaattcgattttaaacacccaaacactagcacgtccgtggcatccattctctgcactctcaactaaaccaggttcgcgatttactggcagaactacaaagcctgaaatttgccttgcagatcttgttrattattctagrtaatatgccggtactaatagataattactgttagaaagaccatgccattgattcgaaaccctcaacgggcgctggattatcatccatcccctagtaccggcaaagaagcttcatgtatcaacatcactcctctctgcccctacttgagacattctcgaagggttatcatctctcggctctgagtaatggggataaggtgacaaagctcccagtgattgagccgcgacggatgtatccgagagttaaagtcattgagctcgttgatcttacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccttattgggacagccttgcataagaacgtctgaaagcattccctattatgtgtgtattcgagctgttgtgagccaatcagggaagacctaagtataggtagaagctcagaaccttatcgtatgattggtcgatattttctttatagttcgttcacgcgatatctccttaaaacagcgagaatatatacatatacaataaagctaattgtatrctgtatattccctcctctatagrttctcgtagctctttaacgatatttatttagcccgtctctaattatcattgaaacatgggaattatccccatatttccaatcgcgtttttcaaatctcatcccttgttacacgccgcgaaacacatcatttagctactaaatgatgttggcatgatacgcccacagtttactcgatctcacacaggcattgcagagagtacaatttattacatcgatacagatgatgttggccttgcacagttccatatcagaagagagacacatacccctagcatgccaggatgaaaaggggctaaatttagtaccttgatgtaacggatcgcaccacggaggccccgcggatcctgtcaggcggcggtggaattacagtcacatttctacgggatgagaaggctcgcgggacaaaacaccgtattcgactggaccaggctgtcactcaggctagcgacgtgtctgaggggtggtttgacgtggctatccaagacccggctgcctccttcactttacaatggaccatgactaggttgtttcgctcgttgtcccacgaacagcgtcaatggcagccccttgcgtgccttgaacaatggcgcgagatcgtaggggtctgcatcgcaaagaataaagaacagaaagagctttccaagctcaatgacatggccttcatcacctcgcactttcttccggtcttcggcggcttgcctacagcagctgtcacccatatgccgactaatagcattcttattattcctccaatggatttagatcaggtgagtgtgcccgttggccactatgtgagattgctgatcatgatctgaagatgtgccgacttgtgagggatacaggcagctttcaagttagtgctgcttttaaagctatatgcttatgctttggagaggacagagacagtgcatacatgtcctctctctcgttaattgagtcacattgcattttcaagaagcttgagatacataagcccccgactccaatgccgtcattctccaactggcatcgtctattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctacctggtttcactctccaatcttttctttgtctcttcgctcaatctccttcaaagctattccttgcacctcatacaaatgcttctgtatctccttaatctcatctttacaattgccagatttcaagagctgggtagcgctacgttcggcagcgctatgcatagacatgaggctgttcgcgagcttattgtatacctctagggtatagttgttgcttccagggataagcccagatcctgagattgacatttggatgtgttgattcctatcattgatcaatgatatcgccttcgggtcgtgagatgcgcccagcttatcaaacaccggggtgattttggaggcctttcgaatctggttcccattctctgagatccagccaacaaactcagaaaagaaattctgtgcatcgacgtcgtagtacacattgccatttggaggagcattttcagagatagtttcgtcgggtatgctctcaagggcagctgctgagagaattccctcttcggacttgggtgagtcggtcgatatttggttttgacaatatgaaggcttggtctgagcaatcttgtctttggaagcactggcagccagctcagcctgacctatctcgatctggtagttgaggttatcaagcctggctagccagctgatgatatcgtcggcaagcactttcagatccatggagctaagaaggtagatacaagacgtgaagcaagtaaggacgagtgctcaatgttaaaagaaacatgtaggtagtcagaatcttctactgatcgaggtggatgatgggctaatacttaagaaggagtatcagtatccaaaccggaggcagggcaacaagactaacaccaaatggcccgcagctcatggtaccagtaaagtggcttttcctaaatcaccaagctgccccctgcatataatgcaaatacataattctttgctaccgcacatagacctgctcctcatctgttctctcggcttcattgtgacaagtattattatagtgatattgaaggcgtaatcggaaaaagtaggtattgaaggggctcgcgaagtggttgaaggatcgcacatcaaacacaatatacagtgagacgatattgcatcagcgacccaccggcttagcaaggtgtaggagtcaaattattcacctcgttgactaggccgctaaccatattcttggtggacagaactgtcttgctcccttgtcaatctgttatatataacccctctccttctttacaacttggtccatcgcacctcaccagcttccttactccatgccttaacaccatgatctcactttctattttccgcctgatctacgggctcatacttgtttttcttggcatattcggaatgattttccgaattagcaccactccacagactactcatttcctctatctcttgattggccaggtcaccctctctttggcaaaagggcttgtgcatttgtttgaacactatgtacaaggcgcaggtttgcttgatatttgtattgatatgggatatttcattgcggatatactcaattggcgttcctttatctacacgacggacaaaccaaacatgttgagccatgttatcttttggatggcctctggaacaatcgagacatgggctgtgttttcgatccatccatcaaccttgctttcagttctgcacattagtattgcaacctcaaagctttttatatacggcatgctggtagcaatgaccttcctccgcctaggagaacagaactctactcaaccaagagaaagcaaatcaagcaccgatcagcagatgatcgatattgaaaaagatgctattgaagagattcaacagatgggaggctactggccttggattaaaacgttctctatattctggaaatttatgtggccggctgaaaagaatgcgcagaacaagctcgtctttgtcactctggtagctgttgttgccagctacttggaatatttatcacaaatgaagctgggcgaactatttggtattctccaaaatgtcaagggctcagggcttacgttaggaaaaccagctttcaaggtttttacctactacggcgttctcatatcggtgttacctataacccgatattcatgttccttggagcaatccaaacttgacggagatcgcagacgaaatctgcggtcagcggcttacaagcagatcatgcaactggatcgaaaatatcattctcatatcagttcggggcaattcaaggacgcagtagacaaagcattaggtcttgtcacgttgtttaactccctgctcctcgatctaataccacgatcaatcaccttagcgtttgcttccgctaggctatactcgatgtatagcccctgggtgaggctacttatgttctgtgggtttctccttagcatggtgctggaacatagatcgttctcatcagctgtgccgaaggctgagaaagccaatcgccaatattatatacaggagtcccagcaacgtaatggtctacaaggatggagaactgtcaccaacttttcacgaaaggatgatgaggtcaagcagtaccaaaaggaaatacatacgtggtctgaattgctcgagagttattactctactacatccatgttcgaatgcctgcaaaacaccatgaatcattgcttgttgcttttcgcgtactatacgatcatgtgtggcgtattaaaggactctgaccaaatggaccactttattgcattcaaagggctcttgttcacgttgttgggcaacaccagtttctttgcttcgtaccctaggacggttgtccgcactcttttcgacgctaacccgctaagaaagatcatggaactcggaattgagaaggatgaaggggacacgctgaaagtgacagagggggaaattgtgtatgagaatgtgagtttctcatatccaggtcgcgagaaaaaggtcatcgatggtttaaatctcactattgctggtggttcacacgttgcacttcttggaccgactggcatcggaaaatcgaccgtggtcaacgtcttgttccgcgagggagaattatcgaatggtgtggttaaagttgatgggaaagacattaccaaagtctctaaggaatcgtaagttttggtcattcatacttcgaagcctcaatattaactacttctagcctatattattccctcggtctaatggaacagatgcctgtatactttgagcgttctgcgagggaaataatagcatacggaaagccgcatgccacagacagcgaaatcctcgaagcctgtcgcaaggcttgcattgacgagcttattatgagttgggcggatgggcttagtacaaagatcaggaaggagtaagtgctggccaccctgacaagaaacacccattaaccgcaattactagcacttgttcgggtggtgagctccaacgcatcgggcttgcctgtgtgttcttaaagaaaccagcgattatgtgtatagacgaaggtactagcgccatcgactctatcaccgaagcctgcttgcgggctcacgtggcagaattctccagcacgttgattgttattacgtaggcgtatccgatcttatcacctttttgagaatatgagttgacgtatagtttcttatcactatagccatcggctgtcaaatgcggtcaagatggatcgtattgtttacttcggcgacggttgcaagattctggaggatggtaaacacgaggaacttcttcgtttgaacggacactacgccaaagcgtggagaataaatatggggaaagagcgaccggacgacctcaagaaagaatcacgctgaggtgagttctattccttgaaccataccgcagaagattccttattcaaaccccaattcttcacgcgatgattcatttagtctgatgtgtattcaggcagatgagaatgggattgtggacatattggattctttacgattaaatagtgtccagaagcattctagggatgcaaagctgcagatcacgattcggtcgaagagccaagggatccggagaaccgaaaggtgccaacggagtgtagtgaccgcatacgcaaagaaactatgtcggagatatctccatccatcgaaattatataagcgagggaggaatgatggctataactggtcctcattaacttaatctcggactattgtgatggggtctcgaataaattcttcatttagaccctcccacccccacctcaagttataaccctccagcagccaaattctacacttgtccttctccctagctcttcagcaaacaggacctcgttgttcaacgctttgtgatactacttccattctaaccccaaattacgaccactgaccgcttttcactccttcgtgaagctaccaaatattagtatataacatatatgcaaacggtaaaaactaacctcctctagggctggaacgtcaaagaggtgatttgtccagccatcaaccttgcccttcgagacctttttggaaagcttgtcgggaactgccactttttcttgaggggtactacctcttatagctgggatgatctctttctttagatcattttcaccctgtaaagacagctccttcaaaatttgaacgatgaccagttcttctttaggtgacatattttctgatcaatgctaagccgggagagtaaaagatattaggaatagatggaatgtagttggtgttgaatgaattgtcctgaacacccgactactttgacctaccttttatagttctagacaaaccttgctgatgctatgtagactgtgggactgatattacggtataagcgaattaggtaggcaagatcagctaccaagcagcttgactacccttgtaatccggtgcggttttacccctacttccatccctaggaattatgtggctgtagtaagccgctcgaatagtatggttcaacggcatgttttaagccttattaacgcttctattacaaaattactaaagtggtcaaggagtggtgtcacgatagcataggacgaacaggaaaatacgctggaatctgactctcgacctcgcatgtgtgcttttttaggctgtatctaataggaacttttgcgaatctctattgagcgcgctggggcgtgtgttatgagaaagcaagcctcaggcggtaaggcagaccctgtattctctcaggcgaggtggcaactcatgcatgcatggcttatacggctctgtccggaccaggcggtgatggagcgggggcctatataaggcgctgaactgtcagtcggtcaatcgattttgtttcctctttcacagctgtgagcacttcaactatctaataaaatcacggtgcctaaatcatattgagacccagaaacggtgctctcttactgttgttagcaaacaatactggtcatagctagctatcaggagctatagcaaccaagggccgtcccctggcgcatatgatcaagccaacccctggaggtcaaatctcatccctctagagcgcatctcaagatggaattctcgaaccttccgagcgatatcctcttgagtattatgggattcctcgagatagaggatcaatttcatttaggcctgtgttgcaaaggccttaatttctttcttaacgataggatatgtcgacagaatctctcggtcggtgacaatccctactgggtacaactttcactaatcaatttagacctatgcaccattctccgtcaacccggaatcagacgctagatcttggaggtctcttgtaaagcggactattgcagtgaagacagctcgtccatggttgctgtctgcgattgctgtttgcactagctttatctacaacgataacgtcgtggtgtatcgtgttgggcaatctatacgaactctccgtcttcaaggatctgtcacagaagagatagctatcgatctgcaaagaatgctccaagctactcatttagatgggtttatattggaggaagtcggactgttgcactatgcgtgtggctttgtctcttgcttattacaagtcaggggcgaaaacacacaatactggcttgcctcatgccatgctgagcgggaggtggtccgattgtgcgagctggtgtccactaatcaaatttttgtgagaaataccgaggactacctctattttggtgtcattgttcatggactgaacaatgatcaatggagtgtacgacaacttcatattacatcagggcgggtgtcctcaccttttctcctaccagagatttttggtagtgaagtaggacaggatacaacctttaaaattattgatgattatttttacggtgtttcaacaattcccgtcaacggcccgcaaagttcattctactcgatgtttcgctttcgaataggcaaccatccttccgaccagattctccccgaggctccattgcagaggatagttgggaatgatagttccattgacaatagctggtctaccattgacctggtgcaatgcgaaagaactggcaagatattcatcaaggaaacaggaaaggaagtcacggatactggctatagccgaagattctgctaccaaaaagaaatcagcccccctggatacaaatttacgaaggacgagaccgggacggttcatatcggggatcagggtttaacaggtcgtatctcaacgtctacgaatacacccatccgttggtacaatttcttgagtggatgctttgttgatctgaccagaagttcggatagttcacggcagccgcagctctgcttacgatcgaggtcagggaggcaaggcgaaagcggtggaaacatcaatgcatggccatcctatgaggaggtaaaatcccttcttattctcaatccttttggtgatggctctgtcaaggcctgggcagcggatgacagacatatattatatttaaacggcgaattaaaagattcagcaccgatgctgatactggtatctttcgatccgcagttacaactgtttgggttggaaggctcgatagcaccattgcctaagtcaatccctgaatcattggagggtgaattcagtactaggccttggtccgacagagtgcggccattctaccttagctttccaagtctggggaaagttcttagccagactaaaaaatagtgtactcaaataaaacttactcctggcatccaagattccaacggccatagtccttgcctatctaaacgcctggaacatcgtcgtctattccatgaccaaagacacttcctcaaataggctcctgtagctgaattcccattccaactcaaagtgctgtaccctctatttctctgaatactaccgttcaaaccatcaagcaagttgaattacactggggtgagttctgttcgttgaaccacatcgcagaaggtttcttgttcaaacaggccgatcagaggcattcgggaactgattcttcactggattcacttagactgatgtgtgttcaggtagataagacgtgggattgtggacatattggatactttacgattgagtggtgtccagaagcattcaagggatacaaagaaccttctgcagatcatgatttggtcgaagagccaagggatccggagaatccagacgtgccaacgaagtgtagtgactgcatacgcaaagaaactatgccggagacatctccattctatcgaaatgacatgaataagttgacgagggccaggtatagcccaccattcatcacctggttcttggaacgttgttatggggtcccgaatagattcttcatttagaccaagccgctcggatactatggtttgatgacatgttttgaatctcgttaacgcctacagctaaggtggtcaaggagtagtgtcccaatagcttaggaaaatacgctggaataaaaaaggcaggcaaagaggtaaaggagccatggataaagcctcagccttgagccagtgatcaacgttgcttcgcagcttgaggatccttgttcggctatcaataatttcgttatgggcatgcttatcatttctgtccttgccgaagctgtaatcgacgaaggcttggtaagtgacctcacaaaacatgaccaagttccttttactcaaaaccctgaacccagccttcagctggaaacatgtgacgccagctggagctatttttgtcatatgcccctgttcatttcaatctataagagaacactcatgcacccagcaaagtagaatttttgcctgtcccactgcacaagtctttgactgagacacttttttctggcaactgcatcctataccaatcaccagacatgtcttcctcaccaatctatcaaaggtctgacggctttcaactcttgcctgttcaacctacctttgaagcatcggaatgtcagcaaaagtctgcggacntatcactaccatatcatgactccacagccccaggactgccagctcctcaaccattaccgttgttgaacgagtatataaaacacaatggacgagagtcagatggtgtcccttcacaggcagccgcctctgcgtcagcgcgagatatcccatcccactatggcagttatagttaccatggacaactagatcgatccttggtacctgttgccatgaccctccccactgtggcgaattctcaatccatcaccgcaatcggctcagctccgctctgtgattatggattacagctcgggcaacagtacgagccctcattacctgctggaacgccgctcacagaaataacgaatgttcaacaaatgaagcacgccgccgacaagatcgcgcgatatcctcatcttggggattggtatcgtaagcagctttcccagcctgctgcttgggttgaaagtccaatgctagttcataagcttcatgccatgagccctgatgttgttgcacaggctgctcgcagggtagtgttcctggggttatatattgcgggagatggtgattctgaattactcttgcagaaattcgatcacaacgaagttatcaaacaaatagcgcagtctcttccacattacagcactgcagaggatggcattcaggtgattgccctcctgcgtcgagttttgtggccttccgtgcggtgccgccatgtgcagccttctcgcaatcgaacaccattacagaatttgaatcttcttgcagagagccttggagtcctggcctgtgatcacccagagcgacttaattcccaggcgttccacttgaaacttaattctagccgcatttttcatggacaaaacatatcagcgatcgacaaggaggtcaggcactctttaaagggcgctgaaatactcattcctcagacggagtctaaattagcctggaacctttctataactcaaataactaagtttgtactctggggacaaacgctgcacctctccgatatagagctgcgccaagagaggactatcttattgtcaatcttctctatctactttaaccgccaattaccaccaccagttagattgcatctagcggaaaacccacgtctagttcagtggagtcgaaaaacactctttatcccgcagagttggggaatgccgaaacttcacgaaatgttactattgcacctgctggcgctatgggcgtatgaaatgtgggcattgggacccccttatctgggctagataagcccgataacctaataatagctctgctggtggcccggacccctgagggttcctagggcacgctaagccgtagcgnnnatagcgggctgtagccactgacccacagtggctgcagccgctattggttagtgatcgtaatcgctatcagatagcgatctcaatcgctattggctagcgttagcagggggttattagcgattgtggccagtggctgcaatcgctagaggctagtggttgtgatcgctaacagcaatctgaacccactaacttatagtggctataatctctcaaattcaacaattataaagtttataaaagactagttcttcttctttaataatagagattttataatcctattagttatattctaataaacctattttaaaagtttttttaaatagcttattataaattctatattcttctagaatattttttagctatttttcttcttttaaatattctatctatatatatttatactagatatctttttccttattctattatatcttctattagttatttattcagctctattcttagattctaatattaaatagttctaagagtagcttttctactttttttttactattagctatatctaactttatattcttattattattcttttattagctattcctaatctattagtactaaatctatatttaagggttatttttatttttatatttaatctaagatctatattatttatcttaattcttattaagataaatttattattatattaggttatagtactattaaagctataactactatatctacttattattataagttatattctaagttatttatagtagtacttttagatattaaaaaataaatatatttttctagtatttagtaaaattttattttttattaattctgattttaatatttaggagtatactattactctatatagctagtatactaattaattagtaggtttatatcttatagctatagtaattctaatataatattataacctcctagtaatactaagttatagataatattaaatttcttttctttaattttaattataaaataattagtttttaaattaataattctattattatatttaaactttaagctttctatattagctattatataggttttctttttcttcctctatagtaagtagaattagttaattactactagtaagatataattttcctatattctatagttaataaatactataagctagttcctcttaatctctatttctataaggatatatatagagcttctagtttttattattcctagggttctctaatttattattaatattattctatactatagccctattataaatagtttaaattattttttatctaattaacttattctttaaatatactatacttattattatattttaatatttattttaaaagttctttaagtatcttaagtatatttatatattctaggataaattattagaattttcttagctaattactaagtttattttattctttagaaactatattttccttctaagagtaatttataatctattcttatttatctatagagataatttcagattctctactagattttttattctctattaataatactattatagtttattcttaatattagtattttatttcttcctaagcttagtactatttaagagtttatctagtaagattcttattatctttatttcttactaaattaagtattatttatttaatatatagataatttaaatacttctagttatagtattacttaatataccctctatagttataaatagcttagttctcttaagctttctatttatattataagttaatttttttatttttataaaccttatattattattctgaatatattttaactagtaggctatagtttttatattctttagagtatttctctagatcttatttaaaaataaagtattagttaatattaggtagtttatttataaaatatagtatttccctactagtatatctagatagtattcctctatatagctataggaaagtattatttctaaccttctattactaatagatagtataaaaaatattataatatattaactataatttcttatagtacttagttcttaaggctttcttctatcctccggatagcttattaaagctatttagatactaaatagtatctatagttctttatctatagattataagtacttctaatatagctagatcttatttcttaatcttttattaataataagtatagactttcttatattcttcttatattatattttttatatacttatattattttttcttatttagtatatatttagtaaacttattattatatctgaatactattttatatattataagcagattatattctagtttctagtttactttatattttattttaagattctaaaatatctctctaatctattattaattttttattactatattataattctaattcttagaatcttctagtatcttataaaggggtagtatatatattttagaaaatttagaaatcttaatattacttagggtttctttctaaatagtttttctaattattctaagagttttagttttaatttttttagttatttctaactattttttattttctctagtaagtttctaattcttctactttttaggctttagatattaagataatatatatctaatcttattatagttatagtatttatatttctctatagctcctagctctataaggtctatatatattctaaatactatagatagtagtagagcttattatacttcttaattaggtttataatttattttaatataattctaactactttatttctcttctttctattacttttatttaaaaagatagttattaatatatactataatagctatatattctaataattcttctagcttattaagtttaaagagttagttcttaatttcttcttttagtctattataaaatatagctttaagagatatattattctaatctagataaaatataacttctctgaattttattatataatctaagatagcctctatttatctaagcttcttaagtttttttataacttattatttataatctatcttactaaatataataataagagtaataataaagttattataactagtaaaaagattaatagtttcctagttttataatttagatttagctttattattatactagttatagaaatatatttaaaatcagtattctatagttctagtaagatatattcctataaacctaattttatctttatcttccttaagctttattagaaagaacttaaagtatacttaaagctaaattttaaatctattaaacttttaaatatctctagtaaaagatcctagtagtattaattaaataactttaccctagttcttctatagtttattcttcttaaggttcttaacttaaagtataaattatttaataatctactaagtagtagatactcttatagtattattctgctgagtaggagttcctagggtagttataatatcttctttattattatatagtaattaagataaaataattagctaaataagagttattaatatataatagttagataatttatactagataggggtctagggtagattaggattaaactaattagaatattattctgagtagtataatcagattattataggctatataatataagttactattaatatataagtattatagaactagtaataatagagatatagataattatattaataactatctaaaagagtattctagctaagtaaaataaatatatatatatactaggggattattaatacttagtaataatccagacagctggattataagaattattataagatccgaataatccttacttgattagctgcgatagcaataataatagtggggtatatatgtaacgcgtgcattgttcaaattcataacagcctaggagtcttagcagcttatttataggttattagactatatttagctctagaaaaatcgggaaaaatcccgccaacttctaggagcctaacctatacccaggctatactatagacagcctaccctagactaaaccttagatcttagataattcctttagctttaaagataagatatctaatatctatatttaactaatcagcttaagagcctctttcagataaaagtaggtcttataaaagctatatatatcggttgaaggttttagtagttatgagttgattttttagatttcctatagtaataaattttgcggaaaatcaaaagtggcctgggaagctgctatagtgggttttagagtagtttttagttggtagatctataagagaaattagtataattttctggtctctctcacaaaaataagattcttttgcgctatattttgcacnnnnnnnnnnnnnnnnnnnnnnnnnnnnnnnnnnnnnnnnnnnnnnnnnnaccctagactagaccttagatcttaaataattccttcagctttaaagataaggtatttaatatctatactcaactaatcggaaagactagctctttcagataaaagtaggtcttataaaagttatatatatccgtctgacggtttggtggctgtgagttgattttttagatttcctatagtaataaattttgcggaaaatcaaaagtggcccgggaagctgctgtagtgggttttagagtagtttttagtcggtagacctatgagagaaattagtataattttctggtctctctcacaaaaataagattcttttgcgctatattttgcactatattaggtccctctagcactaaaactcactgagtaatagcggagttagcagttaagagactgtaagttatagcgaacttcctgctgcgttatagcagccttaaggcccaatacaccttgaaggccactgtaatttcaacaagagttatctatagctataggtttatatagatagattctttatagattaataactaaactatctggattaaaagacttagttagatagagttattaggtttaagaaagagagtatctataaggattaaatctaataaatagactctttttagattaataaagaagctatctatagctataagcttatatagataaattctttaagggttaataaaagaactattagctttagaaggcttataaagatagatttattagaggtttataaagtagctatctagcttagttaaagagatagctattagattaaatagttagatagataactccttatttaaattactagctatttactaatatagtagtttagtagattagattaaaatagaattactactatttattatactttaaataactattagggttcttaaagtataatctcttattattaagctttctagattatctaagtagttataatccagctgatatatagctactaggctgcttacctaagcagagttcagctaatagctagctaatctctactagaacccttttaactataataagttagtaacttaatatatatatttaatattagatatactaagataattattttttaagctagctctagttagtatctagctagattagtttctttattactctttcttaagtagttaatttaaatatttaagattttataataatagagaattactactatttattatactttaaactagctataaccagcctagtattatagatagaatatttaaagttagctataagatagctatagttagatagcttataattaaaacctaggtttataatatctttatttatatataagataatataattcttaaagcttaattctcctctatctactaattatttctagttcttttatagagagctctatataacccctgtttatagtataatactatactttatatataactttatatagcttaatagaggcttttatttataatatagctctaatagtagtaagctagtactataatttaaaaaatagaattatattaatatagataagttagtagaattaaagaagggcgagattataaataaagaagattttcttaagaagatagataagtatcttatattatactaccggctgctgatcctataggttaataggttgcagaggaaagtattccctaatagtaggagatagaagaggctagagccggagctctattcctcgataaagaagatcctccacaatacccggagggacctaatagtgttagcagaaggttagtattatataataagattaggttgcttatacttacagttagctgtaactagaaggaccctgcaggccctatactatatattcataaaaagttaacaaaataatagtaaacaagtcgtatttttaatatatatactacagcgccgcggccctagcttgacttctaggaaaagagagtagccgtccgcagagtgtaactgacgccctggacacatcagttacagcccgcgtcttccagggctatataggttggactggatgcactggcgctctaggcagcgacggtcatgatacggtatttgtcgcgtcgcgttgcatcgcattcgacctgctatcacgcgcctgcgatgtgacagagctagccaataagaaactgggctggggcggctcccgcggatcgcccgattggcccgagcgccggagcaaaacaaacattttcccaatccgacggagggttgtaaacaatgcacgactggttgtctttgcactctcttatctcgctgccttcaccgtcttcgtcgctagtcttcttccatctcatatcagagttcttagctgaccaagccttcttaatgtatatctgttcatgatgcctctgtggatgtgcggatgggagagctgtaggaaaccggccgcccagagagtaggagactgtttgctatgtgacaggcacttctgtcgcagtcatcgtcgagagccgtggcaccaatgcccaaagccagaggtctgatatacccgctcaatgatcagccacggcagcactgcttatgctcacctattcaggaaaactggaaatcctattccgctcaatatgctgctacagagacccgtcacatagacgagctatgccgtcgaatagatcgttctaaactgtgctcccgcgcatcgatccttcggggaggcatcccctgcaccgttgaattgtcccgcaagagcctgtcagctatgatggggaaccagaactgccacgccgaggtcaccttccaagataacgtcaaatggcttgcacgttttcgccttgctaggacctcatcaccacctggggttgtccgtgattggatcctacgaagcgaagctgccactatgacttacttgcaacagcatacctccattcctacacctagaatcttcgattgggcatgcgaatttgatcccgagaactcgattggagttggctatatcctgatggaaaagctggatggaaagtccttggattggcaggcagcaactccattgcagagggagaagattatgcaacagctggttgatatgttcctcgaaattgagaagcatcccttcaaaaaaataggatcactcgtctcggtgggagataccatagacgttcaaggtctggcacatcactcaactttcagagtgggagaaggtccgctcggtcccttcttttcctcgctagagggatcacaagctcttctcgaatcctacctcgcaatgatagccagcggcgagattgatacctgctgtccggtagacacttacctcgcccatcgcttccgcctggatattattgccggcctctgggaacgcgtaccatcaggcggcaagttcttcctcaagcacccagacgataagggggaccatatcctagttaatgactctttcgacatcgtaggagtcatagactgggagtggacccaaacagtttccaaggcggaggccttctgttccccgtgtatgatgtggccggtgactgagttctacaatggttccaacgagctggctgtggatgaattacggctagctgccatttttaaggaaagaggccgtgatgatcttgccaattgtgtcatcgagggcaggagggtccagagattcttcttcgctctcggccctgacagctcttactcagataggaagacattcgcacatctgttcgagggactccaaggggccttccactccggagaccagttatgggagcattggaaaagcaaagctctcgagaagtggaaggatgatgcgttgctcctcagcttgttggaattggagtagaataagggagtgttaatgaattatggtctaaatacatgaccctagtggtaatcatcttgtcacctcgcctcctcttacttgcctaccacaaggcctatatcggcacagggggtcagatagtcttgctcttccagccattattcacaaagctggaaaccagacttccatcaatgtcgaattccacagcaggtctctgctgggctccagaaggcttgtctttgattatcttagtagggaccagctggggaagactctggggtggtggtgatgctcacggtcggcgcaatagcggccaccacttagagcccatttatcacaaccatcttgtgcgcatttctcagccattttattaaaaagataaaagaattcgaaaagcagtggattttattttctgttctgtgcgtttattatcgatgggagagacttgggatgatgagataaaaggggtcgagagtaaaggggcaacaccattctttatatcctaaatgcatacggggccaccatcttcatcatatcggccggtcgatagcagttgcattggctgatacctccacggtatggccgaatctgcatgactcacaaaaaggcaaccttgtccctgcgccaagaccaacaaagaacaggtagaaatgcagcatctgcctacttcaggcaaatgaggttagccgcttgtcatgggactatcccatggctctcgctattggaaatgcagcgattgttcacgccctttcagatagaaagcaattgcagcccagtgcaggggtcctttactcaatgggtgttgtggttgcctaggtgcatgcagcccacgaaccaaacagctcgcaggaaacgagagaaggtgttacagtggtgccatgggtagccgcgggacatttagcttgaacctgcttgaagcacgccagtttaggacacccacctagccattgcaagggggaccgcggtgacgtttacgacaatatcgtattcgacatcatgaacattcagcagcataaccttgtcctagggtattcatgactctgcagctgcaccaagacctccgagcaatatgagcgtaattttagctgaacattggataagccggggccttcgggtcgctagcgccgaagcagtagagcggggcggaagctgatgtggatgttggagggaaattcggatggtgttggcgtggatggtggggcactcgaagtgtcattatatgcaaaagttcgagcccgatattgacgcctgacctggagcgaagcttggtgctataaagcgggcctgtttgtggggtactatgactgggatctgccttattcttacaggctgcactacagagcgattacccccaacggaagtaagcccaaatttcatccccaaatttcacccctcctacatttcgccctcttatattttatctctattttaatttcgttctatctagtcctactaatactaaattttaccttattattcagatcaggcgctataggattaatttagtattactacctctctttagaccgaggcaaaagaggagaaaaaaaaaaaaatctcactcctctcttatctatagttcaattactaccgctcgatcccccagtttattatattagcacctaacctttaggtctacccttaattcctatatttaccctcgggtcttaatattcaaagtcgaggcctcttaataatacctagtttctactttacaatatactaaatctttcgagagacttccttataaacaggtatagctactctgtctgagtacttaaaactcttttatatattattatttagaataaacaagagcagtaacaaaagctagcaacaactgatttattatatattagatctctatagtatatttattactactgctagataaaatctatctgacctactctattgtcctgggaaggccgctagcctaaggagagtgacagctttggtaccgatggctcaggtcatccttgcaggaaactgggacaagatgacttgaatgattttttctatgatgccgtctctttgataggagcccaagatttagttgcatccgctgacatgtgctatcttgatgtggtgtaatcatgtgacccttccttcttgagaaaagagactccctaaactccgtgatgccgcggttcaacaacttacatgtgaaaagtggtttggtgcgtggttttggcactcgcaagtagttgacttctgacattgcacaccaaaatagtgctttgatctcctattttaccaaacccctcatctttacagcttaataaaccaacaattgatattttcgtcttataaaagatatcactatagtatttatataactaagaataattttatgcgttcaaaatatgattctaacaaagatcggttgttgaaatgggcagcaaaaaggcctctaacttgcggcaagaagtttggccacaaacgtacgattgttgacaccctacccacacccgtcccgctgtcccggtatccttctaccgagggtagcagctgtgcctggggatatggagggttctataaagaggctccgacacccatctattgatagcaaagcagtaatcagtattcaatccggtcttcgactatgtactacagcagtggcaattacgaggcgttcgccagaccgctcaaaccggatggcattgataccaagcatgcctggatcgtcggctctggattggcaggcctctcaactgcagcatttttgctccgggatgcccagatgcctggagaaaacattaccatcctggaagaatcacacctcccgggcggtgcattggacggacttgacatccccgaaaagggattcgttattcgcggtggacgggagatggaatctcacttcgagtgcctctgggacctttttcgttctgttccatctattgaagaacaaggtgcgagcgttctcgacgagttctactggctgaacaagcgcgacccgaacatatcactacaaagggcgaccgaacgacaaggtcaggacgctgacaccggtactcttttcacattgagtgacaagtcgcagaaagaaatgatcaagttattccttgccacacggaaagatgtcgaagacaaaagaatcgaccaggttttcagtggggactttttcaagagcaatttttggttatactggcagacaatgttcgcctttcagacgtggcactccgcattggagatgaagctatatcttcaccggtttgtgaaccacattcaaggactgcccgacttctcaactctcaagtttaccaaattcaatcaatatgagtccctcgttcttccgctacgaggttggcttgaatcacatggggtgaagtttcagtaccacacgaaagtgttagatgtggacttcaaaaggtcagtgaacgagaaagaagcgactagaattcactggttggagaagggaaaggagggcggacaggacctcgagctcaacgacctccttttcatgaccatcggttccctcaccgagaactccgacctcggggatcatcgaaccccagctgttttaagggatggaccggctcccgcctgggacctttggcgacaaattgccgccaaagacatagattttggacggccagaggtgttttgtggagacatttctcgaacaaagtggcaatccgcgacagttacgacgctcgattcgcgcattccacaatatatacagaagatatgtcgacgagatcctttcagtggaaaagtggtgacaggaggtatcgttaccgcgcgtgattcaaactggatgatgagctggaccgtcaatcgtcagccacacttcaagaagcaacccaaggatcagattgttgtctggctatatgggctcctcgttgaacagcccggaaattacgtcaagaaggctatgcaagagtgtaccggcgaggagatctcacaagaatggttgtatcacctaggcgttccccaatcagaaataccttcgctggccgcttcgggtgcgagatgcgtaccggtcatgatgccttacgtcacgtccttcttcatgccacgcaagaaaggcgatcggccaagtgtcgtgccagaaggggcacgcaattttgcctttattgggcagttcgccgagactacgagggatacgatattcaccacggagtactccgtacggactggcatggaggcagtgtaccaactcgcaggagttgatcggggagtgccggaagtttttgcatcgacgtatgacattagacacctgctccgcgctgcttgtagtctacgagacggaaaggagctggccacttgggtacccgacaggatacggaaacttctcgttgaaaaattagaaggctccgaggtcggacagttgttacatgagtatcacctcatttaacaagccatttattgggagaccagagtagatacaggcgtagtatcaagtagcacgagtacctatcgaggatgctacgtcgccgccctcagctcgcttaaataataataagagataagtaaacttagatcttagtggcacttgttttgcatactaatcctttttgcaatctttcgaagaaaatttcgtccacgtattcccatgaaatcttcccagtgctcacgacaaaggacgtaaaaaataaagcacaagccgaccgatggtgctgccgaggtactgactataataatcaatgagacaaccccggcctacgaaggggcaagggggacggggcgagaggagtgtaaatgaccgtctagcattgcacttccacaagctcctaggaaccgatctaaaggatagtatccgcttcctttcgaacccaggttcctgtcacgtcctcctggttcctcgcgacaccaaggcgcgcaggggcattagcaggcaggccacaagataacataagcgctgataatgatgtgcgtgtttttagctccttcataaacgatggaaatacggatggccgctgccatcaaggagttccagctctgctcacttcacatttacactggacgggtttagggtaggtcagggatgtagctatagaggggccgggatatggatagattcgtatatgggatggcttgtccattgaaaggctcctctataatttaaacttgcccttcagtgtatctctagaattcatataggtatagcgggatggaaagctaccataatgcacgggaagcgggaaacctaaggttgctagcaacctagaacccaataaaaataataagaggttaatggcatcgaggaagacatttcatacccctccttactcccccttttttttttttttagaaaaataaaaaaatcttcttatctatagcagacttccttgtggtcaagctactggacaaggggtgatttcttactgaccagttgctgtcttccatccatgtcatgtcatgttccctcagtacgtcctcatttgtttctttgctaattactcatagactaatcatagcccggcgcccgctacagaggcgcccgggcgcgcttttagaatccgtgcgcccggacgtgcgaattatatcagcagttaactccagttataatataatagcagagatcagccctattatagctcagataatatttcctaataatatactcctatctgagggtatatataactctagggaggctctccttttatctattaactcttaggtaaagcttagagattatacttttataataggaaaatccttaaaaactctaaatagttaaattaagattatatttatatataattaaaataagctattactaagtatatctactaaaagaatatattatatatatagctaaagaactaattataagtttttaatatttactaaataatctcttaaggaggatttataggttttaaactactagctaagctaggaatatataatatataattactctctaaatagagatctatttatatactctatatactattaattaaaggaaaataatataaaaactatattaagttttatagcttctagagctatttcttaggaaattaaaatttatttttagaaatactctaatactcttataatctagaagaatatttataattaaattataattataaagtaaaatctatataaagattaaagtagtatctaaatactagttaattaattaaataagaagggtttctaatatagaatttaattaaattctaataattagctaatagctattttctttatttatctagattctattatatatttataatataactctaatatcttaatattagaatatatctataaaataaataaatatactatattactttttaatataattagtattaactcctattaatactctttctatattatttttatatttctttctagtaaaatagaaaagaactacttataggttttataatatcttaaatccctctattagtataatattcctttagttattttaataaactaatagctagtagtaataaatactttagctatttagtttttactctctaaattactattttatctttagtatattaataaaataatcttatagtattactaatctatctttatactagatagtaaagattagttagaaaaaatatagaataaattctatattttctaatacttaattataatctctctaactaaagtagtattttagaagtatctaactagctttaaatataaatatactaaaaagtatatagaagctattagatatattaaaataatctaatttaaattatataaggagatagttattaaagtataaatagataaatacttatattttaataatattattattttaagataagtagtttatagagctatagagctatagggaataaatattaataaactttctagagctaaagaaatttattccctaataaaattatatattaaaatttctattctagatctttttaatacttagtaagtaataaaactagctattactaattaattaagagaactaaactatatatagacttcttaatagttatagatatctctagatatctctagagtattatttaaaactatatagagttagattttatattaagctctatataaaatataagaataataatagttaattctagtacttaaagctctctatagttagagatttatattattatatagattattatatatatatatcttaaaaaagctaaagaaaaaaagaaaaatctttttattagaataattttattcttattagtacttaaagcagtatataaactaactatagcttatactagagcctagagtaatcttaagctagtataataagaaatataactaactagtaaaaagtataaaataaaagcttagtatatttaaagtagttaaagctataatatagctaaagatataatctaagtataataaatactatttattaggatataagataatttagaaagtatactcttagtagtataaaaagcttttataattattagtagtattattattattagtaataatatctaagtagatactaaaagtatttatagtattactattagaattattagaatatataagattagataaaaatagttctaattatattattattaatattaatagtataaataatagaatactaatagtattactaataatactattaatataaatagaagtagagtttttattaagatataataacctctaaactatttattagagatatattattacttaagatatatagtataaaacctaatttagtagaattaataaaaataattaaaaatatagaaagataatagatctatctctataatataataaaataaactactaatagtatttagattagaagcagatagatatatactatatattatctctaggttctagagattaaactaagaaagagataatagcttatctagattagagtaagatagaagataattagattaaggcttagatagctatagagatagaaagtaattctttttctattagtagaaaagatatataagtataatagttagataacttatactaaacagaggtctagagtaggttagagttaaactaattagagtattattctgagtaatataattagattattataagctatataatataagttactattaatatataagtattataaagctagtaataataaatatatagataattataaataaactattttattaataattatttaaaagagtatttctatttagaaaataagtatatatatatactagtaactatatataaatagatatcagattaatattaaatctatattatttctaataaaaactttctatagtagtaaatatannnnnnnnnnnnnnnnnnnnnnnnnnnnnnnnnnnnnnnnnnnnnnnnnnactatatataaatagatatcagattaatattaaatctatattatttctaataaaaactttctatagtagtaaatatatactatacttatagagataaattaactaataactttatataactaatttttcttatttttaaataaatataattttaaattaaactaaaataaactctaatatactaatactaaacctaatctaataaaactaatactctgatctaaatataactaaaaataatataaagtttaaataattaatttttaagagctatctctattctaattaacttaatatagtatataatatactaaaactataaattatatattagattataataagtctatataaatagatagttattcttaagatatagcttttcttctaactagtttttattctctataagtatttataataatactagatagactatataataaagtaataaactaaatagatatagctactagatttataatattaaaagtagctttattattataagtagactcttaattaactagaggaatatataataaatatagttagtaaataactatattagattattttaaataatagttattattattttaagagttttattagaagtattaattaaactctaagagattagaatatttatattaaatattatagctataaatacttattaaatatttagtaattaattaattaaataattagtattttaagttagaaaggaaagatagttattactattagataataagcttttccttttagaagctatagctatagctagattatttatatatatctagctatataaatagcttctattattagagtttttaagatattaatatttatatctaggctaaaagtataatatttaactttattttataatattaaaagtttaaatataaactactaattatatttttaaaaaatatatattaaattatatattatctaatcttagaatatatctttatttataataaaactaatagaaaatatatatactagagtaatatatataatataaaatatatttataataattagtaataatatagctaatatatagaatattaactatattatatttatatatataactagatataataactaagaattgaaatatagagatatagggtaggcgtagggtaatgatagtgaagtgatccggtgttttttttggacctaccgcaggtactcgttaaccggcgtgttgacactgtactatcaagtaacggcctgattcagaacacaaacaggctataatggaccattcaggctcggcagaagtatagccaaacttgcaatagatccttgcaagtttagtaaaactggctgtgatgtgtccttgtaggtgggctatatttacatacaatatcacctagcacctaaatttgcactttggggttgcactggaaatgcgaacttaggagttcgcaaatgcaggtgaacgtgtctgttgttgcatgctcttatccggcttatgtaataaggggaataaagaaattccggttatttcagccagctgatgagtaatctctcaggcacgtgatcttgacatgtagcgcagcgatccctttttgagacaattaattctacctacggactagtctcagctaatctcatcccctgagcttgtctggtcagtagttgagttggaagtagacgatgagggtatggtattctgggtatgctggaagcttgctggagttctcctcacagctagtggataagcttgctcctataacaaagttagctcaccaagcgttaggtagatcaatattaaaatcacacacaattcctacgagagtagggggaaacaatgagctactagaagagttgtagtcccaatatcgattatttcgtcgtaccacaatatagacgtcagcattaaaacgactgcttatcttatcacctcttcgcatgaggcccttaatggcctttgcgacattctcattcgttctgtcacgttttcggggtgaaattgagagctcagccattgtgtaaaccgtgcgagttgccatttgaagagtaattgaaggctgcgttctggcctgtatttaacttgaacaaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccaacaaactcaacaggcgcaacaaactgtttcatgctggctggggccaactcgcaaatgcaggggtgtcgcactggctgccttctaaaggggagtgaagcttgcacgcccagatgaattttatatagggtccacctaacttgtctgctcctctccggtttctaaatttrtcgggcgatcttcaccaccaggcayaaaaatttctctgtttctrgcttgatcccccacttgcgactcatccattctagttagcagttgccagcaacatgcatagctcctatcctagcgtgtgcgcacaagtgatttgatggagaggcacatatttatgatgtcatgttttgaaaatatgtccacacatacgtgccactacgtaccttattaccgaataaatatggggctccactctcttggctgtcccaaaaatgggacgtgtttggagaggacacactactcggtgcgagggtccgacgcatcccccatttgtttttagacggatccattcccnnnnnnnnnnnnnnnnnnnnnnnnnnnnnnnnnnnnnnnnnnnnnnnnnngggagtgaagcttgcacgcccagatgaattttatatagggtccacctaacttgtctgctcctctccggtttctaaatttatcgggcgatcttcaccaccaggcataaaaatttctctgtttctagcttgatcccccacttgcgactcatccattctagttagcagttgccagcaacatgcatagctcctatcctagcgtgtgcgcacaagtgatttaatagagaggcacatatttataatatcatgttttgaaaatatatccacacatacataccactacgtaccttattaccgaataaatatggggctccactctcttggctgtcccaaaaataggacgtgtttggagaggacacactactcggtgcgagggtccgacgcatcccccatttgtttttagacggatccattcccaccagcaggcccagagtaagactcatctcctagactctttatctcgctatggagcttgcggagctggaggcaaaggctgatgacatcttccaaagcatcaaactatcatttggaaaagatgctcttcttagctttataaagaatttgtctcggaggcaccttgggtttgnnnnnnnnnnnnnnnnnnnnnnnnnnnnnnnnnnnnnnnnnnnnnnnnnnnnnnnnnnnnnnnnnnnttgagatgttctaccaagattacagcaccaacagagatgtgcaatccctcgcatctgtagctgggcaaacgagacaagccgaaatctgtagtattaatcatttacactgtgacacactgactggtacagataatatcagcgctagaaatgaggtctataacgaatgtagtaacttggctgtcttttcccctgcgaagaaacgcatccgtatgagggatgcctcggtggcgcatgaacttatcgataagagggctaacaacgcccgcgctcaaagaattacagcacctgcatcagaaccctgtaagccagccaaacagcttcagcacctctatcaagacacgatcgttagtttccttaagtcgcactgggaccatctaattattgatggccttttcggtgccactctaagggagactgttgtcttcccggagagcactacatgtctaccccatgagcaacaacgaggctatcacgacatcttgcgggtattaggcaaaagtgatagcctgcattctctacgtcgagttgtggccgaaatcagatcattacaatgttacaccaagtttctagaagaagttcaacttcgttgtggccggaaacgtggcgaaagcgcaaaaaatcttgctcacaaggaatacattcgtcaagtgttccccgacgccacaactgagagtctgaaaatacaccatgcgaactttaaaagcgatctacagtctgctagacggtgggtattgatgattgaagggcatgaaggaaagggtggagctggtctgggaataatcctagctgcatccaagagcttgatctcatttatgtaagcagatccaataaagcaaatcttaaggtcctgtgctgattttgtagcaatagcaaatcgcaggtaactcataaggcgctgcttgagcaacttcaagggttcacaaataatgcacctgcgatggagatttgccaaatacttaacccagttgcacaagtattactatactaccacaagctgccggaggagctagaccggaaacaaatttataaaaatttagaacaaagcattagaaatatgacttgagtgctgggcgcttgttgtagaaactccctgagtagaaaatctcgataaatgagcatattggcgaagaagtaagcggctcgtatagttctttgctgacgctggaagacccagggcacgttatagaatgcctgctcgcgggaactcatctcgttttgaatggggtggaaaaactctggcacgtcgttaagccagccaaggagctccgtttctaacccagaaactgcggcttccataggggcattattatttcttgtagtcggatatagctgtgtcacaatgtgtcccattatcatcgtaagtctgagtcgttggagattagtgcgagaccaactaaacggctgttgagagggttaagccaaacctgaaatgagcgacaatgcctacccatagcttctcctcctgactaccgagtcgggagccgacggcagggtcgagttccataacaagtgtcgcggtcatgtcgtgctcctgcatcgctactggtctgccgagagcaatggccaagtatctaaaaagatgacgttaggaagaatatatcacctttatcgtcataaaatgacgcttacctatcaaccataaagatagcatacagtaaagactttcggaaatggccttcttggggactacaagaggttggctctctttgaatgtcgatcatttgacctaggcgaatggtccacccaagagtcatccaggcactgttgaattgacctgatgcaacttctaattgacactaagtacaacatgtgagaatcttgagtgtcaagaggaaatagggaagtgagattgtattgaggcggtaccttgagcaattgggcttgtaaaatcgccagagttggagggaatgtgtttcgagacttttcaagtctcgattcaccagcttgtagaaaacgttcactagaaataatgttaggcataaccgcagtttggaatgcttgataggagagtcatacgactttcttttccaaggcggcaacggttcgttcctccacgaagctgtccatatacacctagcagattatcaactttcggcagccgacaacaatcactcttggtgttgacatacccaatgcccatgatgaggagaacgatggccatatttgtatggtcacttagcaccgtctcattctccgcgtaaactcggttgagaagctcaaacatttctcccttcggcaaatagcgataggtggtgtttgcatggtcgaagaagcagtcaaagtaagctttggcagtctcaatgctcgggagtacaaaggtgctagcctgattatcttcggtgagcccgccctgctccttgctgaataaatttcgaggaagaccgcgaccgacttgggccagatggccagagacctttcgcagaaaagcgtgaacactggcatcccctgatgctagatttagcagagagcattgtaggacaccattatgtcggtcatagtcatacccgaatcatggtcaattctgattgtttccctatcatcgttgttgggattgataggcgcagctacatgtgaaggtgactccaggccagccgaggcatcctcaccagctgcggtcaaagggggttggttctgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcctgagatcaaaaggtaagcagacggtcgtgtgcccatgctaagggaggcaaaagggcgtacggagcctagagtctatgcagcgctggcagggttcacacccatcgcatttggacttttttttcttacaaacgtcacaagccctacatcattcggttagtccatcgtaagggtctcattaagtggccatcttgggaaggcattgcgacgaacctcgtgacgtatttcttctttgatacagggctcgggatggatgacattgggagagagattacaactcctcttggaagtttccaaattgcaaacagaacaacaatgcagagcaagacgtgctgtgcgtctgtcgagaacccgatatggcgtgcctttggtagatcacgagttcatggagagaaacagctcgtttttttacacttttgaggggccgctaatggcctgtagtcatccncatctattgatggcctgagctttagagttcagctggggggtacagcaggggtttaaacgctctcgtctccgcactacttgtgcaaggtcaaaggcacaagtagtgatataattctttatccctgcatcacagtgctttgcgccccaagtttttaggcagtaaagtattctcccatcccatgaatagaagacctgcttctctacgtcttctctatatcttctctatagacgaataaagttactagccactattttcattcttatggcgctggatcaggacttgagtggactgtattgttcacatatattaactgttggccccccccccaatttagtggggctctatgcccctgagtacttatgccttttgaccgcccttgtacctccatctcttggctccctcctccaccactcttgtctccagacacattctgcacgagccaatcattgattcagatgcgtagttgatgatctactgttatggagtttaagctttacccgcggaaccaaatacctcgaccatcagtctctccacccccttcgagtattcctcgacggcctctacctgtagcgtggtcaattcgacaattcctttctagcttgatcaaccttgttatccggcgttggagctgtttccatttaaccccaattccacttcaataggctgttattatcagcctttttcagctgtacgaggcttttgaagatgctgcagttcgtacggcaggtgcctgtagccctaacctttaaatctctcagaacactaaagaggtccgggcttgaaaagaggttatctaagaagatatgatatatggcaggaggcagccgttttactaggttaataaccacagcctgcgtcgggttaatataagtctctttatctcgcttcctcttccttgatcgcggctttttatcgccaacagtatcaaataccttctgaggcaggtgcggcagctacgaaaggaaatagccagcttcagctatagcccagattttgaacccttctggcgttggctttgacttgataatcactttctcaagcgttctgccctcaaagtgctgaatatacttatccacagcgatattcgtacctgggatctagtattgaagagaggcttgttgtatgactgttgaccactcggaaacccggtcaaaagagccttcgtaggagcccctcgggttatacggccgaaacgcacgataaagctgttcaaaggtcttatggctcataaactgtgcgattgggtggattggcttcatatcccccggctgagaagtaccccaatggtttcgaatacgcttttccctatgatttcccatataaatcaaggtcccaagcaagagatatacttggtcagatgagatagcctagctatcttcaccgttagcttactctcgtatgtgtggttcgaaggggtgtatttttgaagctgttacaagcccggctgcaagcccggcttggctacctacccggtcaggtggaaggtcgtaatttgtgtagctagcccatgaattagctaggtatccaggaataaaaacctggaatagtgacaagggcgttaacggcagctgtgcgatgtgtggtttgcgatttggctggacgataaaggggtcaaaacgcgtgccgcgctcctcggcttccggcttcatagggcgataggtgcagtcagccggctgctcgcgttgggcttcatcaacccggatgtatagttcaatatcttcagaaacctcataagcagcagccacagcaggatcaggatacggaggaatgcttgccatagtaatttgtgtggggaagcttcttgggctgctacgcgtacctcgaagtctcggcttgagggttttaataaaagtggggaaatacccaactgctgctctagctgcttcaaagagatnatggcgccagatcgcactctccgcggatccgttcttgtgaagaacctaacctacgtgaagtcagtcttctgccggttcacccttgatgggtgggctaccttctcagatgtctgcgcgagctattcttcgcgagcagaatctggcggggagcccgatggatatgacaggtttgaattttccaccaaccaattgtgtcccactgcctttggggcagacagaatcattctctgtgtctgtttcgtttgcaacggccaatcgtactgggacaacaatgacggggcaaattacaacatccccctcgtgaaagagactccatcactcgaggaaggcccaactgtattggaatgccaccctccagaccctggaaaagccaaaaacgggcaaaatgtagtgagatctctgatagatggtgtgcctttgaaggtcgacaaacctcaaacacgcgtggcgaagacaccgatcagcttcaagcagccactccggacaaaacagctaccgatgtcgaaaaatatggtttgtaattgggcccccgtttcagagagccattttatctactcgggtcggaaggaaatttcatgtggaaaataaccgcccgtcatctgttggagattgcatctgttgggaggaaggtgagcgaaacctgggataacagatatatatttataaattttctttatatttcctgtgtccttgcttttgatctcacataagaagagtgtctaaaagtgctgtctacaaatattttatattatatactgtctcaatggtatctgctggggtgatggggtgtatcaaaacatgcaccacgtgtggactctaagcgcagaaacctcattttttccttcttctttccttcttttttataattggccccagacagagaaaatgcatacattctggatattacatactacatcgatattggtgcacgcgtaagcgaaacccacccttagaagctattgagcgccgcgtgcctatagagtcgcgtgatgcccagtcattagatggttcaagtcgaggtgcctcgcttctttcgatgtttgtcaagccttcgataggagctcggtggggttacgagggagatgaggaaattttcacccatgtgtgacacagcgtgaataagtacatcctcgccaaacggccaatccgccttgggttccaggtcattgttgatctcgaactgggcatagtcgaccttggggtccgaagattcatccagtaggcaccactttgcagcttcgagagcgtcgtttctcttgaggtaggccccctggatttcggaggaaatagcacggtcggcagtgtacttaatctgagtctggacgatgaaatggaggtggtcggtacctcgggggagacggagcgacccgtctggtaatgctggcaggtcctcgatgttcaactttgtatcaattctgacgaggaactcttgaccagtcggggccttggcatagacgatggttccgctgccgtgctcccactcctcgacgccgtgtggtcgtgtctgatagagagcaaagtctgcctcctcatagccgagcgttgcaagggctttgaaggcgcatttcttggcagcctccagtgtgccgtggctgcctaggacataaagtcgaggaatgtcctccagggtttggacatcatgctcatcaacagtcaaacaagtgtggtagaggaactcggggataaaagtatcatcaatagtgtttgcaggtgccatggtgtcacaattggctgtcggattaaaataacgtatcagtgacaaatgattttgattgttagcattaacaagttaattcacagctaattcacagcccggaggaccttctcttatggcctttgaacccctcttgtctacacgtgagacaggcgtggtgccagacacaatacacgctacccattttcacgttcccacaatgaacggagatttttcatgaacgtgatcatgatcagcaccaaggggcggtgggtcatgagacgattgtgatgaaccgatgatcggggttagtgaaaggcgagtatagcggatctcgacccaccctggcgtcaggtatgatcgtttggatgacacgataacatcttcatgcaagggaggaagaccagtgatgcgggagggcacccgtggcgacgcgtcatcctctaaaagcaagccaaaagttgttcggaaacatggagtgtgatcgagggcaattctaggccgacgcctctgacgataagcctgcatcaccctttcgtgttctcctttggccggccccgcccgggagcatcgctggggcccaggcccaaccccgtcccagtcagtctgaatatactgtatctactgcagtaccatcaatagatttaggcttgcccactcaggagatagcgcggttaaccacattggtctggagccggcagctgatggcagcacacggctcggacgaggttacagagtttccaatggtgtgagatctcgagtttgccatattaaaaattccatccacgtccaattgcgtgaaaatcaattcccatcaagaatcccatcgctgtatcaacgtagactactggacgccccccgaacgctctcgaacatagtgtacatttccttgcgcccctccagtttttcaagattggtctcgctcatggtatggacatgaatatcacctgatgtaaacttttgtgttggacagatgatttggatcagctatagcctgggttgtgacacaccattatatttaccattccagcttatcccctgcggatattatgcgattaatttatccactgatgagttcgatcgcaatgaatcaaaatcctacagttaagagtcacaataataagctccagggggacgatggtgacgacgaatgccgagagcacctcgccctaaccaaggtttgcatgccgcgccccaaaatctccaagttgttactaatggcaggcattccaccaggcccctatcaacgatagcaaacaaaattcgacatccacatttcatatccttggatgttcaaataaagagagtttcgaaaatcggtatagctgggagaggtggaaagggaggggagggaggcagggtttagtgaggtgtctgagaattcgacgtaaggtaggcatagtacttgtgtactttgcgactagattccaagccactgcgccatatgggaggggttatggtacgatttcccagcaaagggaagaagatttggtcaactgacgacgctaaccgacgttcagactagcttggcgctatcgcgggatcagcaaaatggggccggatcggttaacatcggccagccgggtggattattgaaataaacttctatagtctataagatctggtgctattagtatgggtggatgccgggtagctgtgagtgaggcatcaacaagcttaaaaccaggtggcaaagacacgtcataaacgggtgaacctagatgatcggcattggttggaagtcagccgatgaaaagagattcggttcatcatcaaccaatagaatatgatcacatggcttggcttcatcaaatcatcaatcatcagtgcggtcaaagttatcgtgcccattgcggcgagctgtgaagagaagtataacagggctggcaaataatcttgaaaacccccctatatcccttctacgtcaccaaccccaacacttcgtcgatcaatttgaacaagacacgaagcgaacaacttcactttacttcataatgtcactcttctctcgaaatatgcatctctctgaaccaagatacgggtcattttccaggttcctggaagacattgctcattaccctcgcagtatcgccggtagatccactgagcatgaagccgtcacttcattccagcccagcttcgatgtcagggagctgagtgatgcctatgagctacatggggagttgcccggccttgatcgggaagacattagcattgagtttatcgagccccaaacccttatcatccatggtaaggtcgagaggtcttacactgtggttgaaccaccggctggcatccttgaatctcccgaaagtagcgaacccgaggcgggcactaagaaggaaaaccgcccagacgattccaaggatactcctccctcgcctaaatccaaggctgcgaacgctaaagatccaaaattctgggtcgctgagcggagcgtcggacagttctcgcgcacctttagcttccctcaccacatccagcaggacggagtggttgccagcctcgacagggggatacttagtgtgaaggttcctaagtcggagaatacgcagatccatcgaattcagatcaattgaattgtgacagggtgagtggagccgcggggtggcacacgttgatcgtcaatcttggcttgtattgtaatgttctacagtccttaattattaaattgattattggtgatctgcctctgtttttaaagccccccggaatgtgaccttgttaaaaaaaggactgcgctagcataagattggcgaaaatgctgccgtggctctgcacatgtaaacagaatcatagccaagggctatgtaatacaccgaacgtgtgtaaagggtagtcttgagccaattgaggtgtcatttatgctattcaaatacaatcccgcttaactacttgttacaatgtgcctggatgaatgtataattatggaatacggacaagttattgctagcatagactagttacacaaagtgcttgccacatacttaaggctattttagccaacaggtataatatgaaagttgccaccttggcagaagggtcagagcggcgagtgtcgccattgtggctattgtattccactaacaaaaagtgaaggcattggaaatagactcaagccgactaccctgaagaatggggaggatggttcctgaaaaccccctcatcttgaacatagcagcaccacggtgttgaaatatctagcatcaacactctactgtgttgattctgactccttacactcctcggggatgtacggtaaggtgcagagagggcaaaagtaatgcgtgcgcaggtaccacgggacaatgcacctcgaatggaatacatggccgcaacacaaccggcgaacgcgctgctcagccttcaaaggatctaaacaaatggcacttttgagcatgttagcaaagtcaatctcacacaatcagcccaggcacttgtacctaccacgcgtagtatgactcgggccaggcaggttgatctcccggtttatgttgcttggcttcttccttgacctgggcaaagacctttgctggagcttcccggtctaatatttcgagggacggttttaagtcagctgatgccacgcccgccattgactcaacatcatcggattcgacgcaatcggtcggacatcgtgtaatagcgctataaatcttggatgtcagtgcttttgtttgccaagcgagccctagcctctgagatgagataagattaccagagaaagcaaaccaggagcagcaacacaataacgcccgcgatgatgaagatgggcaagagtcctgttggcgagccattattgccctgttgatctccagaatttgaagatgagtttgcggctggaagactgttggggttcaagcccatggttcgtggtgacatcatagtagtcggctaaagaatgatgagtaaggaataagcaattgcgaactcaaaaatactctattcataacaattgctaagtgttgatcctatcttgctagttcttaaagaaaataattccatatcagcctttgtagaaagaaagagacaagttggccaacccgatagagggaccaggtctagactctgccttagaatcaggatcagacgatttcctcagccgctctcccgagtggtgttgtggcgtttggcggcaggctctgaatatttggacgaggtgtggcacgttacgggtaaatggagctgaggggtggatatagtgataaactctattaacacctcccaacagatttatatgccgttgtcaacgcaccgccattgttagtgtagtttgtgagggagctgcatacggtgctcggcgatgggcgggaagcgtgggaaatacaccgcggcgagaggcaccgcgttcagtcgtgttctatcagggtgcctataaatgcttattaacaagttgacggacaataaatatatagaggggtaggaatggatcgaaagaattcaaatataaaaattggtcagtacgcaaataattaaactgatgagtacatagcctagcaaggggggttggagctcatgctttggggaagagagaggttggttttcaaacgagcagtcctggttgatacggaattaactggcttacgccgtatgttctctgtggtgtgtttcggtgttccaattgctgcttcctggagtctgctccgcatgctcaaaacacaaaggaagataatggagtcaacgtccactacacagattttacttgtcctgaataagggtcacatcataccttggatagtcaagatcaaccttgaatatgagaacaaacagctacatacataccaaataccttctcaagaattacataaatcgggctatcaatgatgtttaccaaaagaaaacaaagtgtcggcaaccatgtcgacctaatcatgcatatatatatcacatagttaatccttttggggggggcgaccattggctgcggcgacaaagtgaccccaagtaatcaggtctctactacagtcatcctgatcaatggtgcattctatcaacgtcggaccgtccacatgaactattgccttgtccaatgcctcggtgaaatggtacacggtggatacctcgaagctgagagcatgccctccaccttcctcgccgttgaatgcctggacaagagaagcatacttccagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatgtgcccccactgcatctcaatctcgaatccagcaccgcgagggaggcggagatggatcccgttgaaccacgagtcgcccgtgtcgacaaacaccgtggtttcaggggacaccagcttttgtgaccggcgagcgatctccttccgagtcagtggatctagtccgcgagaggcgcgctcatatggtggatcgagacgtagtcgattgtactcaaccatagtggcgggattccagggcgccgtctctgaaagcctggccagaaagtcgtccagccacacctgactgtagaaagtcgaatcaccaggtactgtgacgctgtttgtgtctacctccaacttatcaacagtgggcatggccgtccatcccacagtgctgtaatcagtgaagacggtgccgatgcagatgaggacatcggcccagttaacaatggcatcagctgcgagggtgctgacttgtccccagaagatgcccgcaaattggggatggtcctcggggaaacggcccttggccgctggctgggggacaacagcacatcccattgcctcagcgagtttgatcacggccaaccttgcgatctttcctcgcaccttgggcccaacaaggatgacgggcttctttgaagttccaaggaactcaacggccttggccacggaaatctccagggagacggcgtcactggacggccggccagtgatggcgctgatcggcccgggtctcaggcactcctcgccggcaatgttggtgggaatctcaatatatgcgggcttggactccagcagcgctgtccggatcgcacggtcaatcagcgctggcgcctggcctggtctggtgatggccacggcgcaacaggtgatcttcttggccatctctagctggtaggtgaagctgtactcgcccaacgtgtggtgtagtaagtggcgacctgagtcgttggagttgggagcgccgctgatcaggatgacggggaggttctcggcatacgcacttcccacgccgttgaaggccgcgaagcccccgacgctgaatgtgacgacgcaggcgcccactccattggcacgagcatatccctcagcagcgagggaacagttgagttcgtttgtgcagccaacctcggagagagatggatgttgttggagtttgtccaggagaatgaggttgtagtctccagggacgatgaagtgatgggataagcccatgcccgcgagcctctcagcgaggtaatcaccgactgtaaaaggcatgatgggtagtggtgctgaacaaattacaagtatgacgagagtttgtctctcgctgatcctgcccgagcaccttcttttgggggggatatctttcctctaaacgcagccttaagaattcattatccctgctccagcatctgggcaggccaccgccacatccccataacctgcatacctgagataccggtccggctatcagtgagatggcatgttgtgatccgttgagtagtgggtgcgggttgaattaagtttaagggaagctgaaggcgccctacagacatgccatccccatacatcgtattcgaaggtttttttttttggatttttttttttgtttgttcattacaggagtatagctgtatagcctcctttgatagaaaacaattacactttccacgtgtaagatgatttgtggcgtcaacctttgatactattttcttcacccatgaggtttctgccgcatgcagtagataccaccaatgggtactaagaaggatatgtttttggagaaaaacaccctatgctgtttaagttctaggtaaatacaccaaaatacaccactagcagagagccctatcaatcgttctaaggccatgccgtacaatcccgatccgctcttcgttgcgtaatgcctactttcctcttagtgaggcaaccaagaagcccatttaggataattagcaaaaagcaagcggccgacacggaacagaggcgagaacgtgtttaccccgcagcgagactggcctctcctccacttgttgaatatcggaacccgccgacctggtgtgggggacaaagccacgggtccagaccaatattcgatgacagttttaggtttgccactggcacgattttacatgccacggacagtatcaagccatgcggttatgtcatgcaatccaagtatatgcggaagatgtcactgccatattcagtggttacgaggatacgcaaaagggggagggtataactagcgtgaacagcattttggttttgagagctaacactgctgtaaactccgctcaatcattgaactgccgaccctaaagagccacccaaaaacatggccaagacaacccacctagggccctacgtcagggactttgaaactctagtccgcagtgatggtgccgtagtgggtggcaagaacgcttctctcggggagatgatcaccgcgctgcgcggacaaggtatccctgtcccaaaagggtttgcgacaacctccttcgcatactggaagtatgtcgatgccaacgacattcgtggcaaaatagcagcacttgttgctgactggcagcttggcaagtcaagtctgggtgaaacaggccaagcagtccgcaagctgttcctccgcgggacttggcctaatgacatcctccatgccatacaggagagctactttgacctctccttggcagcggggcgtcaggaccccagtgtcgctgtgcgttccagcgccactgcagaagatcttccagacgcgagcttcgcaggccaacaggagacgtatctgaatatctcaggcttcaaagatgtcctgaatgcctgccgacgatgctacgcctccctctttacagatcgggcgctcagctaccgccaagccaaaggttttgaccacacaagtattgcgctctcagttgggatacagctcatggttcggtcggacattggaggctcaggagtcatgttctctatcgacacggaaagcggctttgacaaagtcgtgctcattaacgctgcctggggacttggtgaaaatgtagtccagggaaccgtgaatcccgatgagtaccaggtgttcaagccactcttgtccaataacaaacttgtccccattttgatgaagaagcgtggtgacaaggacgtcaagatggtttacggggaccggcatgaacccacccgcaatgttccaacgtccaaggcagagcaagcaaagtatgtgctggatgacggggagattgtccagttggctcgttgggcggttatcatcgaatcccactacggctgccccatggatatggaatgggccaaggatggtttcactggccagctgttcattgtccaggcccgaccagaaacggtccattcacgtcgcgacgccgcgcatttcaagacttacaaagtcggtcataaaggaagacttcttgcgactggtctttccattggggacgcggcaatatccgggagggtttgccttatacacagtccaaaagatattgaccagttcatcgataactcgatcctcgtaacgagggctactgacccggactgggttcctctgatgaagcgtgctgcagctatcgtctcggaccatggtggccgcacctcacatgctgccatcgtgtgccgtgagctgggtatccccgccgtcgtgggcaccggcaccggcacatatcacctgcataccgggcaagatgtgacagttagctgtgccgaaggtgataagggttttgtctacgagggaatctccgatatttccacacagacaatcgatctcaagagcctccctcggattcacaccaaggtcatgctcaacctggccaaccccgaggctgcctaccgatggtggagactcccggccgacggtatcggccttgcccgcatggagtttgttgtgaccaacgcaatccaggtccatcccatggcgcttatgcaccctgaacggatcaaggatgaagcggtcagaaaccaggtggcaaccattgcgtctgcgtacgaccacaagcccgactacttcgtcgacaagctggcgcatggcctcgcggctctctgcgccaccgtctatcccaaaccggccattatccgcatgagcgacttcaagacaaacgaatatgcggggctcatcggcggttcggattttgagcccagcgaggagaaccccatgctgggattccgtggagcctcgcgttactactccccactctatgaggagggatttgctctcgagtgccgcgcagtgaagcgtctacgtgaagagatcggcctcatgaatgccattgtcatgattccattttgccgcagagtcagcgaggccaagaaggtcctcgaggtcatggccaagcacgggctcaagcgtggcgagaacgggctccaagtctacgtcatgtgtgagatcccatccaatgtcatccttgccgccgagttcactgagttcttcgacggcttctcgatcggctctaacgacctcacccaactgacactgggcgtggatcgtgattctggtgagctggctgacctgtttgatgaacaagacgaggccgtgaagcagatgattgagcaagttatctcggtagcccgcgaaaggcattgcaaaattgggatttgtggtcaagcacccagcgatcatcccgagttcgcccagtttcttgtcaatacgggaattgactcaatctctgtgagtcccgatagctttgtgcaggttatgaatcatgtggtagctgctgagaagagcataaattgaaatggtttggattgggaatctgaagttatcgttcgtctatagttagtataatatgtagctcgattttttattaagaaaagaatatcctcacatcccacttgaggaagaagcaacaataacggtagattacccccttaacggacgacagtacgcaagagcaggtgttaactgtgtatgtactcttcttatcatttcgcgtaagaaccatcatcttgccaaataatttacttttatcttttttttttgttttgggggggggtacattcgtgacacgatgagtggaaattttacacaacgaatacggaccgaggacacgaaaaccaaagtcgatttatactaaatcaaactaacattcctaagtaaaacgaaactaattcgatcgtagaaactcgctcactgtaaaatatactagttatcttccaggacgttctccttgacactctcaagacgccccttcagcttcttggccgagtcgcgaatgtgtgcgtcctccgcatcgtccagggccagatgaatggtacctatcactccttgccttccgatgagtgcgggaaggctaaagcagcagccaaactcgggctggaaatggctcagcgggcgcacatttcgcttgtccaagagtatggagcggcaggtactcgctacaaccgaagcgatgccatatggtgtcgctcccttgacttgcatgatcatctgggctctctcacggcactcgtctgcaatcttgtcaaaatcaaggctcttgggcggcattgccttgctgagggggctgcctccgagcctcgccatcgaccataccgtcacttgggattccccttgcacacccaagacatagatatcaatggaattcgcagcaacctggtcatcaatcagtacatttgacttctattccatgcttaatatgtaattcccaccttgagctcgctagccacgatgccccgcagccgtatggactcaagaaaggtcccagagcccaggacctgatgtcttggcagcccggacagctcttgaacaatggatgtaaggaggtccacagggttcgccacaactatgatgatggcatcggatctaaaaggggacatttctttcattatgctccgtacaattgaaatgttcctatcggtataatccatgctgggttgacctgggacatctgagcaactcgaggacacaacacgggagaagactgtggtagacttaccgataaaatgtctagatccagccgtgatgacgatgatgtcgcattgagcagcttccgcataggtcgctgccctcacattagtgtcttccttctggctgaaagccacgtcggcgaggtcccggacctggctgtctctacggctgacatcagtatcaaccagaagtacttcgttggtaatagatgtaaggataatggcgttcgccacggcccccccgacttggccaacgcccacgatagcgatcttggagtttgtcctcatcctgtagatagtgttgtaaaacgatacgatagttgagaaatgtttgagtaaagggccgttatctcttccttcagaaacaggaacaccaatggcttcttaaagcgctttgactagaaatatccctaagtaagccactcacatgctcacaagtttagcgaagtcatttttcccccgcctatctacccatatctataccagatccagtcctcacagtagagtccatagtgttcagttttgaaaaccgtgcgtccatgtgccgcgcgatcattctctagcgcagttccccgccatatcagaccatggccaacaaggttcggttctagacctcaacccctcagcatgacggatccggccgacctccaactgtcagaaaagagcaagacttactatttccaataacacccaaaagaagacatgctaacatgacatcagatcggatatctgtaagttttggctattcctgaggagccaacaaggtttgtaactaagcctttcgtggcttgagatagcaaggagggggtggctaaggaattacgatgaaagctttcctgtcacacacctctggctgaaaccgccatcccattgtggtgtagccagatcaccctattcaacgcggccgcccgcatggtgtggtatgagtatctctgagtggcttggacgatgttacatgatatcggaagcatactcgctcggtcttgcattggaacccccatatttccgtttgtccggtgcgtatactctagatacggtaatacatgcctaaggaacagattcgttacgatgaaaccggtgtttcccatattttcccattattgtttatttggaatcgagatgcataatgtcgagtgatgaattacgagccagctttcgccccaattagaagaaggggaaaaaatatcagaatgaagagaattgaacaagttatcattcaaattcctctcgaggccaccacattttcgaacaaacaaggtatcattgagcgtcacgaatttgtgtcccagtatctcagaataagctaatacccagctaatcgattcaataatattccaaataaagatcactaaaaagcatcggaaattaaaacttccccaaaaaaatcaaaaaaaaatcccataggggtagatatggaaatgttttaaattctcattgaactactcattcctttggtgaacgatcctcatcccccaggcagggctttctagccccatctcgcgccaagccattcaccaatctcccgttgcaattgaacgtagggtttgtcacaaattgataacccaaaaaataccaagcagcagcatttccaacggtagtgagttcatcactcattccatttcgagcggctagagacattctcttgtgtagccttttgtcagtgaaaagactcatcatatgttctgccacagccgcccggtcccctggccgaacgataaatccgttcactccgtcctggatctgaattgaagcaccgtcaaacggcgacgtgatgacgggacggcctgcgtgtagagcctgtgctactctgaactcatcatcttcggaagcggagaactgcaacacaacatgagagtttctgacaaggatgttcaacacttgatcgctttctcctagtatcattatgctgatatctcgctggaagcgcctatagacgtgctctagatccctcctagcatcttcgtaaatgagctttctgtctggatcgtctatagacccattaccgcagctacaattgtgtgtatttgccgtattacagagatactgttgtaggagcgaaggagggaactcacattaccagctggggagggttgacatttttgtcactaatgaggcaacgaaattccgcatagtagctaaagatttcggagagctcctgctcagattcgaagctcgctattgcaaaaatgtatttgcctgaatgttcagctgatgttccaaattatagcacgaagtagcaacacttacgtgaaggccatctgagctccgtcatgtggaacttataacactgggaattgtagaaatgcgtgtagaatcccgtgtcccacatactaagactcttgttcaaaccatcaaaccttgcaacatcgtcagcatggaccgcatgcgttaaattgatcgttgtccgagtaattaccagtcgaaagttggtgacaaatacccaaccttttctcgaggcgcctcagccgggagcgactcctggatgggataagtgaggaaggcatcggcatgcttgacgtgatcccagacaaagccccaaatatcattctcgagagtgcccgttcttacgattaggtcatttctcatttgaatgtgggagcaatacaatacggggcgatttggtgcggctgcctttgccaggggtattaatccaatcatctccaggtcgtcaatctgctacataagccatctaccacagtgaatcagtagaggggggcaggtcttacaatcacaatgtcagcgccgccctcctctggtgatagaaggggcccgccttgtataagccagtatcgtttggcattttcagcaacccagtcgataattgagtttctgtccagccattccatgcgctgatttggctcaacgcctcggagtatgttcttgatggtcttcgtgacgccaaagacacctctccggggcttgggcactaaaaatggcgaagatatgtcagacattatatcaaaagagagtagtcccacccgaaggttggaaagacataccttgccatgtaatgggtaggccaagcagagaggcaaacctaataagcgcatgacgtgcaattggaactccacctccctgcggcgaggcactgaagaaggccatcttgatacgcctctctcggatcttgtctgcataaaatatcatcgtttcccatgtccccagtgagcatattcccttgtagtcttgtagttgagctagatgggccaaaccgctcagggagacctgtacgacaccatgccagccgacctgaagtctagggatagtagagggcccaaagcacctatttcataagtcccgcattagcctttgacccggttcaggctctctatggccgaaaaaggttattggggctcacatgatggacttgcgggccatggaatcagccagttcatcaacaggctttgctacccaatgcccgttgtgtttagtctcggcgggggctggaataacaatgggaacgatgtccagctccagccatagacgggagcagatgagcttactgtgatctaacacggaactcaagataccgcagccaatgaactttgccaactttccacgctcatatgacttgaggtagtcgatgagatgatcagtaagtccattaacaccggttttatcattaattacaacgtctgcatcatggaagtctctcaggtagagcgcatcgtatattgccaatgcaatacggaaggtgccatcgctcttaatgacggctgagatgccacagtatagtttctgcggataaagtgagtcgagacaagataggtagaacactcgacagcctgaggacttacagttaaaagccaagtgataagggcaatctgtctgagcaataaatgccccccgcctcatatgcagagactgacgcgtatgtggcagtagtagctgagccatcggttcgcaggtgccgtgctttgcggggaagacaggattgtagcacagtccgaagatattatatgaagttgactcacgaccacggcagggctttctcattttcaaatgatcatttaggcatcagcgaacagtcagtcgcgtggtgtgagcctggaccgttgtgtggcgatcttctagccgtaaagtcaaaggtagacctaatcctgtttcgatctgatgccgccacttatacttcagtcgtggacaacacgcaaatatcgtaccacttttagtgatcagttgcttcgggcaccccagtcttgttgcgctaacgagaaccgcccctcgagtctaacttgccgggatatggcatctacaaatcaaagtcttggttcgtctaggcgaactcgattctaccatatgctactgtttggagcataaccagcttcctctttattagcatatacggcatataaattaatgctccacacagtattgtttatgagaaaattcactggctacatgagctgcatggcttgagacctcgaaactaaagcagttgtttgtctactttttggacttggccaagaacaggtacctaaatgccacggccaatttacactttacatcattaggaaatggcaccgcacacagctataacagagctagggggatatctagtccaggtgatttgagggaaggcatatatttatgaagttatattttggcataaaaagtacacacttagttaaatacgtatataccagtcagcctaaatatagtacgctctgttaaggtacagtatactaatgacatattgacggtagaagcgtagctaacaattagagatatagtatgagcatatagaggggtgtgggtttagcgttagcaatctatcattccagtgctgcttatgtaaagtgtccttctcagagcaaccttaaagtttaggctgaaggttgcttctttggtatgcaagagtaaaataataattccatactgctcatattaaagtctcctttccagaggaaccatgaatcaaatcaggcctgctgagtctaggaacccaatacagctggaccttaaggcctggctcctctaggcaaaacaacccgttattataacgcattacatcgcctataagggaagccagccaaataattttgattgaatagcatttcatgaagtgcccacattttctcctagaataatatagttttcttccttccctttccctgccactataacaccaaaatgccccaaaacatcctgcgcttattttgaagtgtatcatgagcgcacatgctctcgaggcttttacacttctctttggctagcaatgctacatatcaaccttccaaataggacctttgttatatttggttgagttcagcagccaagcttcgataaatataagtggacaaggttcgctcatgttgccatcagattcctgcagacttacaccagctagccacattgacctatgaggaagccgaccgggaggcaaagccccgaacaacactctcccggttcgaagtagcatgttttcccacgtggcagacaccgaccatttccttgagctggcagcgcggctgcaagtattgatccgataaacaccattaaaagagctaaagcggcgcgcattttggtaaggtaggatttgaatgaaattttagtgtttgatgtcgagtttggctgcgggtataaagtgttaggaaggcaaacacaaacgaggagagctgtcctacatcattcttatagctgattgcaggcatatcagaaaactgagaaaaagtgtatggatgcgtcgagagctatgacagctgtgctacgtgatagcgtttcgtgtatcatacattctttcctcgcccgtgtgttggttaaagaagccataataaggcctgaatatgaggctcggtatgttttgaaaccttatataccgtaaattgctttagcatgattttgatttgcctattaagtctggctatttgctaaatccgtagccaccgtagcggcgatatccacggctcgccagttccacttaaatgaactgtttttttgactgaaatgtgcgataatttaactgatataagatgaaacacaaaaaatgctctctcattccaggcccaatgctatataggctgtgatttaggatggctatccgtccagttactaactaaagaagatgattaactcatacgtgcctagtcaccctaacattcacagtgctacgtcatgccatcctaatgcagtcgaacctcgatcctttgagagcctgcgagacgatggttcaccagcgtggtctaggtacttggtatggattgaattccaatcggtatgtatctatctggcatgtatctcatcattctcctccttgtgaaatagcaattctatggcttctacttcaactatataaccacctaattttgcgctgatacgagctcgactgaaccttggctgcgattctggagtgggctgtgaattggtgggtgcctatttctaggccaagtccaagaaaatggaacaaagaactgctttggtcccaagtctcaaatcgtgtagattttgtataaagtgaatttttatagtaaatcgtactgtgtggagaaccagtcaactttcagcatatgtttataaggaggaagctggttatggtcctaactgtatgcatttacctcaatttccgaattcatttcgaccacagataagagttgtagcccagaatcagcacatcacccgcctgcagtaatcatgattgctcacagagccacctcagaactagtggccttttgctatgcccatagccatatgaacaaacaatggcaacctttagtagcactgatagccaccttgatagtgaggacagtgctggtgctatacaattgaatagattcttgagctcaaagttcaagctgggcgtagtgtgtgaacaattctttctatcagtggtcatatggttgctatataattctattgtagagctacaagccactcatgggatattatggtgcagccactcgagtcgaagctgaccaaagaccctagcataaaagggcaagaggagccgagagtaagtccaattcgagaaacgtatatggacgcaagtggtgaacaacgtattgttcaagtcacgaaattccaattatatccctgcgctgaagtgtttcacttgtgctagacctcaactacctttgaacttattcgccttaccgggctgaccacaggacggctcaccaaaagagagcatccctgtcttcaataagaataccccaagtatcttcaggcgactcatatgtacctactatttaaagtaatattagactttcccgccatctctttcgtagacagattgcttctaccgtagtaaccgcctcgatcgaaacacaacttctctccttctctatcctttacaatacagcagagaaatatagacattaattaaattaattcttattctaaaagcgtgtttgatctcctaaatggtgaatgtgggggatgctgttatacagcgtatgatcaacaacagtctgtagcttctttcgtcatgtgtggctgtctggggctgtgatatgcacaaactccgaggaggcttctcacgtgatgattgatagaatctcgtggaaatagaccataccttgccgtatttatagcatggggcgtgcagttagaaatcagataacaagaatcagaaaaaggcaagaattggacatatgaggtcattattgaacacaaaagctagaaaatactgtatgagaggccaaggccttaccgaagtctagcctccatcatacattgaagcacaaaaaggcttattccagtcatatggctggggcttccatagcggtttcttaccactaacactcgctggtccttattatatggaatatatgtatgcccagcaacaagcccagaacagcattaaaactagatacagatttggcggtgatttgcgaacccaatagattactgcttatattcggctttctcttttccagtctcttcagtactttagaggcttattacacacccttgcaggtacctacagatacttctatatacatgagaatctttttcagccattaatagccctatttcagcctctaattattgcgctaaagtgaattccccggaaataaagtactgctgaagatagtcactcaaaagtactgctaagtatataacggtttggacagtgctactttatactggcaggtacatcacaagcagttcaaggtacgagggcatgtgtttcaggtttcatatgaaatcacgtgaccgataaagaatgcagattttgcttgtcatttgcgtagatgtgtagattttatttacacattgatgacagcttgagtctcatacgggtgcattaataccttgcaaattatacatatagagactaaatttcgtactcttcaccatcatctgtaaatctagaattacctccaaattaggacagagtgtagctccaggaacctaccacagtatggtaatagccggtcgataaacccatcagacttccgtagtagtcgaaccctcgtatacttcagaatagagaacaccatcaagggtgtacgcaggcagaatctgatccggaagcgtggatatgcgcctaaaggtgttgtgccggagcaaatcaaacgatttcaccggggcaatcggctttccaatgcctaaatcacaacaactttcgtcgataacgactaatttttttttattttttatttttatttttttttgggggggggggtttcaacctatgggagggacaggcctaggaagttataagagagggtaacggtagggatgccaagggtatcggcggattcctaaagccgagcaaagatggccagataagtagagcttgaagcacacgcttctacaattcctcctcttctactctcggaccaatcaatatacagtacaatccacattcacacagtcacccaaagcaatcccgcgaccatccgtgccgaatgtatgtgagccagtattctcatacaggatgtcttctacagcctgtagaaccgactgtcgccgataccgccggatcacccgattatcagacttattccgatctctacctgtgcatctgaagcagttggcggcgcttctctctagttcagtttctatgtgccttaattctctttattcaatttccgctcaactgttttctggatagattttggacaggtttggatgactgcgacggcttgccgactttagctggctatatagcacctttcgctggagttacaacctgttttttagcaccttttacctggtacgctcgccccgtctagcttcagagcagccaggtcaagggtttccagggacggctgaggcgttgctgatgagccgacggactctgtgtttgactcgatgtcttctacttcgccgcagcccactgggcattggcagatggccctgtattcctatggcagttattgttattttttttttctcttctactctttcccccctgctcttgagatttgagcgctagaggttgtggcaggatttgctcaccaaacataacatattactagcatcagaacaatggcaggcccgagaaggcatagggccaagactaccgggaggttggaatgctggccttggtgatgatcaccattagaaaatgagcgtggaaggaaggtagccgagggccatggctagcggtaaaatcgcttaggcgaactgaaattggaagagaaaagaccaagttttgaggatcgcgataatgcccgtgtttaagaggtctttattttcaaaccgtaggtcaacgggtttcgcccttaaaagaaaatgagacgaaatcagtgttgatacagtttggagcataaccagcttccgctctgttgtctttatcttttttgttcagataagggagtacctaaaagtacctttatatacattttccactatattacattatgggaaaacatccattaatggctaagagataagtatctccaagtcgattaagtactgagccaagaacaatgccgcccacagtaaaagcacgatggttcaatacttatgatgggcaacatggtacatcccataggacccagccatagtgtaggggggccttatttacgtcctctgaagtcatgccatcccccaaataacctgaccaaaatgcagggcattgtatatacataacggcagcctgtatatcgcaagatgtaataaggtacacagcattcaaggttgtcaagattaaatattatattatagagagacaaactttgaaagtgtgaatagacttatgaatggcttattcgtactcagtcatggattgagtctatcacgtgactacgtaaatggaaggcaatggaaggtcatagaagtggctgttggttggttggctcattgtcgctgctaacaaacgtaggaaacagaagcagcgagaaacatctaccaagtgccaccctcgtgttatgctaatatggatgaaactatagataattggtcaagcgatgatgcaagcgattctcgaaactctgactctcttccctccaatgacgatgagcatacagccccctccagaagccgactgagacctgccggaagcgctccaggattcgtatcatatttagactgggagccaagccgatcctacgataacgagccgacgatacattataatgtggagtggaagttatctgtcaggaacagaggacaagccggtgaatcagagttacatgtcgtcatttcgccgcagaagttctggaaacacatcctccgaccgaaaatcatcaacgcatgcgtagaacagccctggaaggagaagaaaactaagcttattctttctgtaacggaccgcaaaacaagcaagataacaaaagagtttccaaaactagatgttgactggacatttgttgctaggcagattcaagattggggcaagttcttgaatgacggcaagaccatcactgtcacgttgatattctattatgacagcgtagataacagtaagcccggaagaggaggagcaacagccaatcaagaggcagacttagatgctagaacagccggtttaggccgaggcgtatgcattaggaaggcatatgctcttgtgcgctgccctgggcgtccttgtacaaaaggggattactgctggcagcatgaaggaaagtattacccacttcgactacatcatatcaggatgcttgctgatcatattcaagcagtaaagctgttcaacgggcatgatgatgccccagaagggttccgtcgactagtgatggatgaccaacgagagcaagaagagagacaacagaaggagcgtaacaagctgcagaatcgcaagaggaggcgacgcgagtctaatgactcactatctgttacgactaatttatgccaccatgatattcccgagatggtgttcccaatatcgccactcaagtttgatttgccaaacgaggatgcagtcagagcgtacactgtctggcaccgcgctcgtgtaagctccgaacagaaggggtactatgatgagattgaggttttaactctagcgaactgctttactctggatatacttgccagcaaccagaatactttatacaagttctacattagggaggggataccaaaaggtattgcatggagttatgtttgctatgtccagcattatttaaagcaattccaggaagctcagagcatctgattatacaattagcactatcttttagtctaaatatatctgcgccttcctgaaatgcccccttgcgattttcttatcacgacccacaagcctgatctgcataagtaaatatgacttgagatcgccctgaatgagatccctatcatctattgagtacttccggatgcggttcttaacagaaccaaatagaaattctatagggttaagatcaggggagtatggcggttgatactcaataatcacacccgccctagcaaacctttcctttatttctggggaaaagaaatggaatgaggcattatccataaatataacagattgtggctctgggtatctgccgcagtatggcagcagcctctccaaaaagccctctaccacatcaacatctgtgttatccccataaacctcacaatagatcacaccatttacggtatatgctggcagaatttggaccctctttcctcgatgaaagcgtttgacctgcactggggtcacaccctttggagcataaccgcgtccaagtagagcgaccccacgatcacaaccgctttcatcaataaaaatcatgtgttcgggcctatagtgtgaccgtcgctctatgtaatcgtcacgaagatcttggctacgctctttcgcaccgttttgtgtcactttctttgtccacccgacccgttttattattcgtccgatagtaaaccgtgatacgtctaagtcgtagtgtttataaagaaaatctgccatttgctgctgactcgtgcaaggatattgttctaggtagttctgtaaagctagccacatattctctgtgatttccctaggtcgacctgtgacttcacatggtgcatcgattgtgccatattcgaggatattcgatcgggctttgcgaaccgcgcgtgttgaacaagggatggttatagctatgtctgaatctctgatcgtttctttaccctctagcttgcctataatgatatcttggagtgttttacgttgtaagtcggatagccgtggtgccatgtcctgatgatgtaaagtgtgaattggccgcggcatcagggtgcctgttagtagaccgtttgtggcgtgatattgattatataatccctcgagcggtcaacaaggaaatcggattatagatagaccgaaaatgaacagagagaagatcgcttcttagtcatccataagctttgcgaaccaagtgcgtcatgaccatctgcctgttatttccgcctaatcgtccttcccccgcattaccaccatcatccttcgcgacaggacgaaatgccagaagctagcatagcgtgtaaagctcaactaatagcattggtaatttttatctcttcgatatggctcctactcgccctacttcgcggctcggattcgagattgccatcatctgtgccctcactattgaggcagacgctgttgaggcactcttcgaccagtactgggatgacgaacgccctttcggcaaggcgtccagcgatcccaacgcatataccactggttccattggccggcataatgtcgttctcgcccatatgcctggcatgggaaaggtaaatgctgcagttgttgcaacacattgccagaccagctatcccaacatcaagctagctcttgtcgtcggtgtatgtggtgctgtgccctttgtatcggatgccgccactgaaatcatcctcggtgatatcattataagcagtggtgtcgttcaatacgacttcgggcgtcaacttcctgagcgctttgttcgcaaaaacacactattagactccctgggcaggcctaagttggagatccgcgcgcaattaggcaagctagggggcaggcgcagtaaagcgatattgaaaaagaagattatcagtcatcttggagaactgcagaaagaatcatatttacaagcgcactaccctggtgcagcccacgataaactatttgatactaattatcgccaccttggggatgggaagacatgtgaagaatgtggatgcaatggagaccttataccacgccgtcgctttgaacaaaacgatattcaaccggaggttcactttggatttattgcttccggcgatacagtgatgaagtttggggaagaccgcgacaaggttgcagagcaggagagcattatcggctttgaaatggagagtgctggagtctgggatatattcccctgtatagtgataaagggcgcctgcgactatgccgacagtcataagaccaagaagtggcagcggtatgcatctgcaacagcggcggcttgtgcaaaggctttcttggaattttgggagccttcagccacagcccaagccaccgatcaaagcaagacaaagtgtgcgtaaacaaatgcgtggtagggatctttgtgctaattgggttctagtttttgtgccatatcccagtaacccggactttattggacgcgaggatatcctactgcagcttaaagagaacctaggccatgcacagcagaaaaccgcatcttcttacttacgagtgtcgctctttggcttaggcggtgtcgggtaggttttttctggccctatctattacttaaacaggggattattaataccaagcaggaaaacacagattgcgctagcttacgtttaccggctacaagagacgtaccctgctatatcagtcttgtgggttcatgctagcagcgccgaccgcttccgccagtcgtatatgtcgattgccgaagagtaccagatccctggctatagcgatcccaaagttgatatcctgcgattagtgaaagactggctggaaaagaaggactctggtcaatggctcatggttcttgataattcggatgatatgcagctcttctttggttctccggcagccgcttcgagcctagctggaccacgccaagcaggccacttctcaaattacgtaccggagtgccgccatgggtctctcataatcacgacaaggaataagcagctaggtgtccgactgactaagggccaacagccggttaaggtccgtcgtatggacaaagatgagtctgagcaattacttcgtaccaaacttggtactattggggggacacctgcagagttattattgttgtcgtctcgattggagtatctgccgctggctcttgctcaggctgctgctttcatccaagagacctgcataacagtagcgaaatatctccaactgcttggagagaacgaccaaaatgaggtgcttctattaagtaaggagttcgagactattgggcgagattcggagagtccccgagctgtggcacaaacgtggattctttcattccagcagattaagcaacagcatattctagcaagcgaactcctctccttcatgagctgcctcgaccgccaggacattccagcacaatttctttcgtgctatattgaacaaaaagaaaatgaagaaccaaaaagcaacatcgagctcacagaagcattaggggttctcaaggctttctctcttgtgactgaagataataacggaagttacgatattcatcgccttatccagctagtaacacgtaagtggcttgctagtagtgacacatggaatcatttcacgaaggaagcattaatggtggtatcaaatctttatccctatggcacatatgagactcgggcaacatgcgctgcatatttgtcgcatgcaaatactgtactcagattatgcaatttcagctcaggagatgagcgcaaagcgaaggcatctcttcttcattgcatggctgcgtacctgtggttcgaagggctgtgggatgacgccgggccgctcaacctagaagggatgcggataagaaaagagctatttggcggggatcatcccgatacactgacgagtatggccaatcttgcatcaacatataggaatcaaggccggtgggaggaggcagagaagctacaggtgcaggtgatggagactcgtaagacgaagcttggagcagaccatcccgatacactgacgagtatggccaatcttgcatcaacatatatgaatcaaggccggtgggaggaggcagagaagcttggcgtgcaggtgatggagactcgtaagacgaagcttggagcagaccatcccgatacactgacgagtatgggcaatcttgcatcaacattgtggaatcagggccggtgggatgaggcagagaagctacaggtgcaggtgatggagactcgtaagacgaagcttggagcagaccatcccgatacactgacaagtatgaataacttggctttcacttggatgtctataggcaaagaaacggaggccatcgacttgatgcaaacgtgtattcacctcagggaagttaaactgggggtagatcatccagatacacaatcatcagtcttagctctagatagttggcaaactaactaacgcacgcgatatgtatgtattgattatgcatccaacctcaggttgccaggctgacgacttaattatataatctccaaagttgaacttcacaagacccttacgttgaacgtgtgataagcttgatgccattccaaatgatgatgtgtgacggttgggtgacttacactggacgggggtctagggtaggtcagggttgaaccaatcagagtgttgttctgagtagcgcgatcaggttgtcgtaggctgtgcaatgcgagtcactgtcaatgtgcgagtattgtgaagctagtaacaatagatgcgtagacaattgtattgataactgctgagagagtgtttctatctaagaaatgaatgtgtatatatactatggatgagcgacgtgatcgttagtgagcgtcgcgatgaggatcgctgtgatcgatgcgatcttgtcgaccatttctgtgtgacatggtgattggtggaaagagtgggtaccacacgtgacttgtgtacggtttgaggttaaattcgtaacatgatgtaagtgtaaaatggttatgacattgcgatataggcagtgtgcctatttctgggctagtccagaaattgggaacaaagaactgcttgagttccaagtcgcgaagcatgtggactttgtatatagtgcattctatagagtattagcactatgtggagaactagcttaaagttagcatgtgtttaaaaggaggaagctggttttgctccaaactgtagcaagtatacaataactgctctcaatgcaccagattagcgaggggactagagtctagactcctctagatcatgctgcgggcggatggagaaggggtggagatggtgacagatcaaactctattgttgctcgtcgcatcctaaccagaactatacgactcaatgtggctccgtggctggcgtgacacaacgcaccggtacgtacggcattcggcgagagaacccggggttccccgcgagacatcggaaatggggacatggcctcagcgagatgccattactcacgtaatattcttggcaatttgcttccgccaacggtagaacaactcgctaaatcaatcagtatcacaataagccacccggattgcgatggcgcttccaattccaacaggagaaaaggtgttgtcacgataagtagctttatttatcattggtggcacatcatcatattctctgcattagcccattcgaaaacttaagggttgtaaatgttagaatacaggaataagctaaatacatatagggtttgcagcagttaattaattcaaaacgtttaatacaataagtaaaataaatggatagagcatgccgccatcttacattcagtcattcacttgctggtatctaccacgtatcgaccggtgatggtatccattctcatcttgtcatacacctcctgcagctggctaagaccaagtgttttgtgaggcgtcttaattttgcccgatctgaagaattccatggcctctgctatgtcgaggcggttcccgacgtagctgcccttgatactgatcatgcgaacaacagtgtcgaatacgggcgcctgtaggagggcctgacctggcatgccaacgcacacaacggtgccatacggtcgaacatacttatatgcctgccggaacggctcctcatgggtcgcaagaagcagggcagcatgggcctcaagcccgtctgggatggcggcacgaagatctgcggcgatatccgacgactttttgtagtcgataaaggccacagcgcccagttctttgcatagttgggccttgtcttctccagtatctacactaatgcaatttattcccatagctgtgccgtactgaagtgcataggaccccaggcctccgcctgcgccgacaatgataacatactgtcccgggcgagcaccagactccttgagccccttgtacacggtcagcccagcgcacatgataggcgcagcatcttctaaattgcattctgtggggatctttgtcacagacccatacttctcgttcgacacaagcaaatcgttcatcaagctaaaaaaggattatattccaggccttggagacactgtcgacttcgtcatcatcgggggaagccgcaatgcgaatgatgagcaggagcttagaattgggaagctatggtggacggcattctatattgcatgtgtggaaaacaaaaatgagttgggatgttccaattctaagccgaggtttcgcattgtggatgtgctcaacaggcacagtatctcgaaagacgacatcgtatacctcaatcgacatggatatttcggacgagcaccgttcgtcacgtctatgccggagttcgacatcgtatttgagcccggacggaagctgcagccagccgagctattcaaatatccgtttacggtggaagtggtcggcgctggcttcgacaaacctgcgaatgacgcgtattttactctgcgatttccacgagtgcttaaagttcatgaagaccgctcgttcaaggatgtcattagctttgcggagctgcaggagatagccgcgaagtgccaaggagcccctgatgatctacgaagagaagaggaaagttggcttcggagattgcgaagcggcgggcatctgggcggaagatcgaggaaatctcgtagcggcggtttatcttcacccgccagttatgtaaataagcaaggcacgtcggatcgggatgagggaacaactactgggtctctgcatcaaggtaatacttccttccgctcgccaaagcggaagatttccccagaggaggtcttggctggcagctcaattcccaagcgagcaaagcaagattaatgtcagggatgtaatagagagttgcctgtaacaggaatgagatgacccgtcgtaagaaatatacactttacttacgccgccttaaaaacatattaagatggtctgtactcttcttcatgaactcgcgctagttcaaatgctgcgatcttcctcgggttcaacccatagagctcttgaaaactcatgatcatggggtgccacaaatccagatcaatacggttcttgtgatcagccattctaatgctttcttccacgtgggtccggaggaccttaacctccaaggtaataaagcccttttttaccagagctgaatcgtatcattccaacgttcaggccaatatagtacagcaatttcttttttttataaaaaaaaaatagctggagcttggtgccgtggtaagaagatttgggattaagctctaacccgaaactatatactggaatgcatagtgtggcttcaatatcacatacggaatatgtcctgttaccaattactatactcagtatactagacgatgcaatgaggacagctgatgcgatgagcacgataattattcttcagttgagatcgttaaggaaaactcaaaatgagctttgggagacacaggccgccaagctcaaaagtaaccgcaaggtataggggacgttctagaccatgcccagtcttgattgcgattatttctggcttagcactttgggttgggatactgaaagctcctttacattttataatcccagggcttttggtttaagttcaaatgacgtaaaattggaatatctatgatgcatacaacagctctccgtgttgaggggttgacaccaaacctgtaaacccatggacacaccatatatatccgtccccattaccacttgcgtacagctcaaattcatcacctagcaacaatattgtatgcttcaatcaaaccataattgttctaatatatattcgcctgctgcgatttttattttcgagttctaagatgaacgacaatgaaagtttggaagatgttattgcatctttcaggcagacggagtcgagtttccagaaacaacttgatggaatggatctaaagatgatagatgcttcccaagagaaacgcataaataaaattgtttcaattctcgccgatatcaaggctggtatcggtgagattgagaattcatacatcccacttcgtgtggttggtcgtattacctctcagttcctcaaaaagagaatttcgatgttcaccaaagcggtgaatatcgacccccaggagtacctggagtcgacggccgacgataaagctaaggggaaaggtgcaattgtttcactctccaaagttcgcaacgactttgtggaggatctgggtatcatcaggctcgaatgcacttcaaagcgcagggccttgatcgagggcaagcgactgctatccataggttagtattctctattttcagatgaagggctctgcattaataatatttctcgtctctaacgggccttgtaacagacggtggtggagtccgcggggtttgcagtcttttggtattgaaggctctcatgattgcggtctaggctgtcaaggacggccaggatgagctggaatttcccgatcattgggaagattttaaaaaactcatagttaatgaagatccacgggaccactttgaccttgttggcggcacaagtactggagggtcagcatcttcttcgtccccccgcaaaggcattaatcgtactgactcattttatagactcattgcaataatgatattccgccttgtaagacctttttctattgattgtattgaacacaatctgataattagaatatagggcctatccatccacgatgtggaggaatattacgatgctatgtccaaggtaatattcgcgcccagacgatccagttatattgggggcaatatagcacgacctcttttcaacagaccttggtacagcggatctaagctgaaaggtcaaatcgagaaagtagttaacaaagcaggggaacccccagacgcaatgatgatgaatggtgtggacaatcgaactagagtgtgagcattccagcttccgacttcaaaaccaattgacgatgaggttaacatctttctagcttcgtatgcgccgtaataaaacatgggcatcaaaccattaactttcgcacttggcggccaagcaagcctccgctgtttgacgacataggatgtagtattgttgacgcagcacaagcaacatcagcggcgccattatactttccttcccataaaatcgatcatatcaagtactgggatgggggtttacagaataacaatcctatttgtcaagtctgctgcgaaaatgaaagcgacaggccaagcatcgttctgagtctcggtactggagtccctgaacctgttgcaaagatgtcacgctattctccgagctctgatgcccccgatccgggaggtgatcttcagaaactcatgaatccgagaactgtcgccggaaggaggtcgcgcttgagtttgcctttaatctcgaaagttcaagctatgttcaaatttgtaacagatgccgaagctaagcaccgagatttcgaaagactcctcagcagctggagtgtgcactaccgccgcttcaacccgcatctgaatcaaaacgtaacttttaccgactattcacaaataccgaatcttattactcagacgaaagcgtatttacaaactccaatgcaaaaggaagaactcatggtagccgctcgattacttcttcaccagccagaggagctggatcctttgggctgttgctgaatttcagaatcttcaaggccattctaccacctcatttcagtttaaaaatcacaggatgactctactgcttggtctatttccagaatctagcggttcagaagttgaaagatagccatgaggtgatataaccgcgaccgaaattatagagcctttttgatggaaagcaaggagatgtctaaggaattcattgggcttctgctcccgaggctgggcttttcccccgcatttttgagcaatatgcttaccaaatgtggcggaatatatcacaggatggttattgtttggcgttaaacctaaattgtaactaaaatttcacattggtgaattactgatatattttaagtactacttcagtactacagcgtgttcagactacctgcgtatcaactttgcgaatctgaattggaggatagttctaaacttatagacaggaatgcaaaatgcactggaatgcaaagtgatgcaactggatgtaactctagtctcaatccatgtagcccttcctctatcttcacttggtctagactaccagtgtaagtgctagaaggttagcgttgcgtagttcctaaccttattacgcctaaggaagaccacaaagtgggcacgaatattgagcgaagtgtatcaccgccacagggttaccctttcttggtgtggaaggaagccgccgtcgagccagggagagctcactttgacgaatcaactcaagtggtggaagtccaccacctgagtgagtcaatcgaccgtacgatcacccaccgcgataacatcttctgagaatcacgggaatacgcaccatggcatgcccaaccgtttcacgtccttgtgcttctgctgcacacacgccgctcaatgaaaaccgcgcagatgaaattaataacgactcaatcattctgagctctgaccaggtctagcttatcgcctaggctggactgaattagacttagttgtggctatgcttctctgagcctgtttatgctgcttaggcgatgatatcgggctttctcgacatggccagctgggctataagtagctgggttccggtggcttgtggcggccgttgtgcaccagataggtctatttgtgacatcactgcatcacctgcctcgttcttgcgtagttaccctccgtatggcgtcaaggttattttatctttggcccagattcttataggtaatgcagcctttacaaagggttaccttaatgtctttctttatatggttaagaaagcctgacttgaaacggatatatagatttacattcaaactctgtccgtttatagagctgggtatgacatcacattgtcgcgaacatttaaacagaattcaagtacttgtagctctagcattcctagtggcttgactaattgcactgttgcctgtagctctatcaggcttacattaaagagctatattaaccttcaatgtatacatttcggcatctagactctcaaaacttcaagaagctctggaatgttcaaaagtataattgagaaggatatctgtttttggatgcaaactttattgattatcaaggataggtataatatcaccacttttgcgcaaaactttctttaccttaactgcttgaactatagcgcctagctctaatagggtttcattacagagccactagggcgttccttagacatctagactctcgaaactttggggtctggaatgattaaaagcagaacttgagaagacctgctacctttccactgctttccccaacataaccgccaactatatacgttgacgtgaaccacggtgcgaattgcaactctggagcctgctctgatttctccagaatatccaacggattctaccacctcatctacacccaatatccttctcaggctttatagtaccttcgtgtacagtagcacgcacccgcccatctaaaaagaaaaaaaccattgtcaaaacatgtctatcttccccaatcttaaaaaattccgtgatatagtcaagtcccacgtcggctccgacttgaccgagaaatccgagccgcttctctctaaagtactcaatcgcttcgactcgatcctcagtaaccttggcgatcaagacgagcccatcgaggccgccaatcgcaaggtgtccactaattggggccagctgctggaagacgcagttgactttctgcaaaacaacaaaggcctcctccaggatgtgcagagtcagaccctcaggatcgatgaggatattggaatcctcattgatattgcccacactaaggttttgaaagggggtattgatgataataagtatttggtgggtattccatttgcttggaagcagggagggacggtttgctgannnnnnnnnnnnnnnnnnnnnnnnnnnnnnnnnnnnnnnnnnnnnnnnnngacaaaagattaaaatccagatggagcgtgtcattcagcttgcgatttcattgcccgacggctcagatatacaaactaaactcacgggaaccctggtcaaggaattgtgggatagcttgcaacatccgccattgtcgtatctgggtgatgagtatgagtatcgcaccaccgacgggtcgaacaatgtatgattatcgcggcagaactttccagcacacgatctattggctaatcacattgagccgctagaaccccctgtatccaaaactcggaatggcaggcacgccatatgtaaaaagtgtcactccactgacccctgggaggccgtacccggatccgggagaagtgttcgatagtacgtgctcaagcagcaaaatcaatgaatcttcgcccgagctgacgcttgacagaactgctggctcgtcagggaccaccaaaagaacacccgaacaagatctcgagcatgctcttctacatggctactattatcatccacggttagcttccttcccnccttcaaacccctttttttttgccagcatcacaccaggggaaggttgatctgaccgacatcagatatgttccgtaccggcgatgccaccgaaaaaaatcccaacccgaattataaaatttcatccacttcttcttaccttgatttatcccccttatacggcaacaacgtccaagaacaggaagctgttcgcactatgaaagacggcttgctcaagcctgacaccttctctgaacatcgtcttctgggctttccgcccggtgtctccgcatttctaatagcctttaatcgctttcataactatgtagcaggagaactgaagcgcattaacgagggaggaaggttcagtccgaatccacggctgagcaaggaagatgcagagagagaggttgataaacatctcttcaacaccgcaagactgtacgtatcctaagcctgcgcagggttagcgttaagagtgccgtcttactgacaagcttactagtgtgacatgcggtctctatatcaacatcatcctctccgactatctcaagacaatccttaatatgaatcacgcccccgactccaactgggccctggatcctcgaaagccctacttcgaaaccttcgacaagggtagttcctccctgagcaccggcaaccaggtctccgttgagtttaacctcgtctaccgctggcaccccactgtcagcgcaagagacgagaaatggacgcaggacttctttcaaaagctgttcccaggccaggatgtttccaaactgtctctcccagacttcctcaaagggctctccaactggaggaacgagatcatggctcagaaaccggaggcccgcacttttccaggattggagcgtgacagctccggcttcttcgggactgaggctctggcgaagctcatcgcggagagtacacaggatgttagcggtaaatgcccccctcctttccacccactaaacgttccacttacataaaatcctatagccgctttcggggcgcaccaagtgcccgtcgtgctcaagctcgtcacaatgcttggcatcagtcaggctcgtagctggcacatcggcacgctaaatgagctgcgcaagttcatggacctcaaacctcatgagagtttcgaggacattaaccccgatccgaagacccaggaggccatgaaggccctctacaaggagcctgattttgtagaaatgtaccccggtctttttttcgagagtgccaagaaacctttgtatcctggttcgggactctgcgggggcttcacgatggttagggccgtcttcagcgatgctgttgcctcgattaggggtgatcgattttatacacttgtatgcttgcccctcctccctctcctctcatgtctacacttgcccagaaatagctacattggtagcactttagctaactcttgactctacttcaaataggactggacacccgctacaatgacgaattgggggttcgatgtcattaaagcagacaagccacaggacaagctcgctcgcggcggtaagatgcaccatctactggacattgccttccccggtttctataaggacaactcagtctggaagctgtttcctttcacctctcccgacgagataaagcgcatctttgagaagcaaggggttgcgggaaagtatgacttctcgagcccgctataggagcggacttacctaatccgggttgtcgtcagtagtagggataaataggcttgtacttatggtttatgggttgtaagccacggcttcctcaacataagctctcatgtatttaattctattttcactccacgccgcctcttaagctctatgtaggaatgtataagtctgaagagtgcttgttattttcgtgtattcactaggaacgattggctgtcctatgtctgttcatcaaaatgaatgtctcttgtcttcatctatcttcatcctgcctattcacagcgaaattaaataggagtatagacttaacgaccgcgaagctattaataaccggagcctggtccgtcgtgaaagaactaggatcggatgatagcgtttcggttagcagacaagtgttaggacaaatcaagggaaccacaatcacctacgaatgaggatcataaaatatcgtgagtcataagttggaggaactcacaccacactcaagaaatacgcctcgacataagcatgcatatgtcacgtgcacctttgggagcccaaggcataccccacctttttctaccaattatacactggatcaccgcactcataagtgatcccgacgatcccaggaactggatcacctagatcactaaccaagacagagttgtttccctcttctgttggtacctccatgcaccaacaaattccccttgacgagcgctcgtgcactcttgaccgcttttcctccaccctggtgagtctgggctctgcaagtcgcgagaccattttgaagtggctcattcaggcatccatacatggctccctccaaagtctcacgctcctttcctctctcaaagtcttcaggtttctgatctgctccattctttggcgccctccgaggcgatccccttagactttattctgctgccatctctgccgacttcgacttcgaatgacttacaagcctccactcgcaaagcccttcgcttccggttcacatccagcaggacgaagatcttcaggctgaacctcatatactgatcccaaaccccttatcatttcaaagttatgcaaaggagaaccagtatagtaatcaacctatgaccctttggaccacacgtgtaccatgataacccgccgtcctgctttgcgcccacctcgcgtaaagcattcaatatgatgaatatacgcctcgtacctaagccaatgcccgagtacacttcgatcaaataagtttccagtacgggctgaacacgctgcgaaatatcagtaatgcatacgaatatggtaagtactgatgaacttactgggtggaacgcaaagccggcgttaaaatccaactcgtattccgtaaaataagggaactctctccgttcgagttctaatagacggtcccctgcagaagcatcttctcagccaaagaaaccatcttccgaaagagaccttatcatctgcgagatgtctgtttacgacatgacttcaaagacaccatatatgtgtcgtacccttgtgaatgagggatcgcgttggattgatataaagtagcggatctatattcctccgtttccaaccacatcgtgctctactgaaacgataattttggtttggcgccatccgtagatttgtggaccttcttgaaaccacaatcgtcaagatggtcttcctgttaatggttttcccaaatctaggccatttgacttgtggtccctgtccaccgccacaacagcagccatttctagtagtaacgagaacaccacaattgtgtggtcattacaactgtttacaattgctggggccattcctcttcttggttttgttgaatgcctgggccatggtatgttacttgtgtaagggcgagtgtttcattcaacttcagggggaagatatccggtagttgtatgggatgttacttctcattccgtctcagggactcatagttcgccacgaaattctatccggcgtcttcctcctcatggattataaagttccacgctcccgtccagttcgctagaaactgctctggtcttgtagtatagagtactcgatacctttactctctttcttgcattctccttacttctctcaggctccccgaagtgttcatcatgcagctttctacgttgcttcccactctccttttggcggcttgcacaaaggctactcccctggatgaaagcattgccgtgaccccggctgatgggcaatccaatgctgggcaaactaatgtcgccgtgagtgagtcatccgccgctgctgccgaggtagccatctctaactgcagcggtcggtacaactggtacggtaacggagagtgggcatacaccgagcttcaattctgcttcgtccaacgttccgcttcaaccgtcgctgtcgtaaagcaacgagagggtcaatactactggggcggtgcctggcattacgcgagaaattatcctttttcctggagcatcgtgggaactctatccgccggtgaggatttcgatgggtctggttacacagtctctgtcaatcattaccaagttggtccttactgggaggacgacgctgccatcaatgagaatccgctgttcagcgttgtgcttggatcttaagaggtgggccacctcattgactaacatgacctagaattcctttcttgtgttcttgaagggctgattaaaaattaggagctgtcaagtacaggaatagagcaccaaaatcgtcttgtatggtttttttttttttttttttttaattctcacctaggttttccttatactatatgcaaatgcagaggccaccaaactttatttccaacgattcattgaaatatctgtttatgacctactcgtgtcctaaagaaccacattggatacaacaagaagaggagttaattacctgagtggataaatataaagatctcattaattacttattacttcaaacagctcattgaggctcctaattttgggattttattcctattatatatttaccttaattttactatgaataatctaatttatataacttacttagttattaaattaattagatttaagtacctaataattagtattaaatacctaatattaaatattaaatatctcttaaatatggcagaagcgacgagacttgggatgtcatcctaagctaccttaacattattcgagatgcagatcgagagcagtgtaatgcagtgccgcaagcgcaaggagacgcagagggcagaagaagaagtccattgacgaagaagatgaagattatgaacgcaaacaagtagaaacagaacaggcaatatatcaccaatacaaacccaacgacttttgatcaatcctgtagcgaagaacaggggctgtattttggggctgtattttgcaaatgattggcaaaccaaagtaggcccctggaaatatgccacgaaaatttctccaacagagaacacagggtttagcacgaaaatataatcaggcaacgccaacagcacaatttctatgtccagcctccaggacagctttctaaaggcggggtacattcctccctaaaccccccaactcgcaagccgagcacgctcggcttctatttccacattgacacatcgatccagtgcattttgcagcctcctttaatatttcctcaaccagggacagatgccattaggatgaatggcggtacagatgtattcgctgcacctactggctcctgtgcctctgcagacttgaagagccccgcgatgcagtggaggtgcaggatgaggtttagggacaacatacatgatcgatccgagtctgtgcctgtcatgtcggaaagatggagtccttcaggggtcaatagaaagtgtatgtcttggatgatgggttctcttttaccattcccaaaaatctcatggtagtcaccaaatgacaacgaaacacactacctttaattagtactttagccatcgagaaatatcgcaaacaatatactcaatcaggtagacaatatactcaactaggtaggcaatacacttaatttggtagctagacatttctacgttcactctacgatggcggcggcagcgatgaaatactggatgaagtgagaaaaaggtatgaggggaaaagatgtgaaaacattgaattcatctgggctatttgcgtttattcaaaagaccagtagagataagcagaatatccaaagtgaagacaaagagatgagctccaatctcacacaagtttggtgctcatacgaaagtaagtagaggcagatgcgtgcatgcgcttgcttattgttcatgtgtctagatttcaatgtgaccatcattttacatgacgatgatgttcgcggaattctataaagacagaggggaagtagatctgttgccaccttagacctcggcaacgcgaccgacagccccgcgcagctcatcccgctccaaaagtgcctcgttcacactctgcatgccgccagtcgccataatctccctggtggcctgctcgatccaagctgcttgtcattccataggggtggctcctcttgtgcctttgactcgcccaccccaatgaagccaccctcggcagcccaatcagaggtgcgcttaattccaagccgggtccagatctcgtccaatgcctcggccagctcaccgcgatactgcttgacatggcctggtgtgggggtgattctcagacgttcctggccgacggggacggtggggtaattgatggattggatatagatgccgtagtcctgcagaagcatgtcggaggctgactttgccagctcgacatttcccacgagaagcggcacaatgtgagaggggttggggatgaccgggatgtctcggttgttgagctcctccttgacggcgcgggtatgcagctgctgcagctttcggtcgccgtcgtactccatctggtactcgatcgaggccttggcaccagccattgtggctggagggagagaggtcgtgaagatgaagccaggggccagcgagcgaatcatgtcgacgagcttggcactgccggcaatgtaaccacccacacaaccatacgccttgcccagagtgcccgtaatgatgtcaactcggtccatgatggtgccgcggggcatcccctcgcgatgtgcctcccagtctagatgctccgccacaccagctccgttcggtccgtacatgcccactgcatgcacctcatcgaggaaagtaatggcaccgtacttgtcagcgagatcacagatggcctcgattggtccgattgaaccacacatgctgtacactgactcgaatgcaatgattttgggcacatgcaggggcagggatgcgagcttcgcctccaaatcggcgacgtcgttgtgcttgaacacaatctttttggttccggagtgtcggataccctgtatcatggacgcgtggtttaagctgtcagagaggatgacgcagtcgggcatcttgctcccgagagtttcgagcgtcgcatcattggccacgtagcaggagctgaacacgagagccgactccttggcatgtagtttggctagtaacccctccagttcgacagcgtgtttgttgtgtccagaaatgttcctggtgccgccagccccagcgccatactcttccagagtctgatgcatagtctcgaggactcgggggtttcgccccattcccagatagtcgtttgcgcaccacacggtggctcgcacctccttatacgacatgtgggcgtgcgggaattccttggcgagacgattgatgttgttaaagtagcggtacgacttgtctctgtgcttcttatctagttcatgatcgtaaaaggcattgtagtcaaagttagaggtcgaattacaagcatcagaggaggtcagaggagacaccttgcgggcatgacgaaacatgctgggagggaggagcgggcctacaaatttcgagtcaacatggccagaggatagaaactgagggtaaagtgtctctcacctttgtcacgtccccggaggaccggcgactcggcggccttggcctcttggttgcggctcgtgtgtattttggctctaccagtcttgggctggctagagaaggaccaggaaggggcggcagcaccgccgtacttggcggtttggacagccatggccttactcataacaggacagcctctggcgaggagctgcaggttcgaagtacgaagtgtcgacattgaggtcatgcttacaaaagggcacacagccttcgattggcgaagaacagcatccattacgatgaggttgagtggtcagggcgggggggggggagggtttgggtcgtgtctctccccaaaaattctgtgatgtgggaagttggtgatggaaatgttctaaattttccgtcccgcggtcttcttattaagaatcggaaggcgcaacccgcagccgccgcagcgcccgcaacctttcggcaggtctcgcatattttgacacaggaaggtccgtttcctcggcgccccacaatccactaaaacgccaacagaagagtcatttcagtcacgctgcagcagttccaggtgcacccagacctcatggaaagtaattgcctcgcgctgattggccaaccccatccatgccgtgcatccgttcatatgtacggataatatgtcccctcgtttccttttccccttctatgcttcctcgttggacgttcgaggaaattatatccgaacgtttatttccacccacaaactcatcataattacatatctccggtaaaggtaatcaactagtacttgcctgcgtaaaagaaattgccccgcagaacaacgccccttcaattcttcatcctcctaatggtcttacccgtgattcgtgggttttaactgggcatcttcgtagcttatggcacttaactttctgctagcagaacctacatttgtaaccgcaggttggaaaaactgagttcatgggatggagccccctacatatcagtggtgatgtggtttgatacacacaatggaccagtaacgctagaaccaagaagattctgttatgctatatttgctcccgaatattgaatgcggttgtctgggctatactggcatcctttcttgcaacaattataccaagtttgtctccaagcctcttacgaagttggtccttgaggaatctcgagattgcctttaggtatgggctcctaattagcgttgttgctgtggcggtatcggtagcaaatactatctatctcggcattgcggcctacgagatagacggacccgcctttgggaagtcgaaagaaaatttccttatcgcctcgattgcggtccttccggcgtctattgcgtgccaaatcgtcttcctaaccgtttatttgattacctatcggcaagtaacgcatgggggggggtgcagtctcttcattctagggataaaccacgacgctggccgaagtttcgagccaagacagttccgtatagtcaaacctgcccgctaacggcggaaacatttgtccaatatggtcctagattagggtacggtcgaaactttctggagacgtctacttatcccaagcaacactcgctggaaactatccccacaataccgataattgccgaaagcgtgaagtttgactcggtagagctggagccgtggcctccaatcctatggccaagtcgaagctgcagctctgtggtaagaaacccaccgcaagttacacaatctcccaacgcttcaaacaacaagttgcatattcacccgctatttcgctctaactcacctacccagcggcctattgcaacatcaaatactaccgttgtggtatcgccaaatacttaaaggggcttcgaaatctaaattttttatcaactatccccgttgcgccatcatccctacagagacgatatgaattaactcgtcggcgtgggtggttcctccatgcggtatggcgagcttggttggccagtgcttggatatatgttccgaaaagtggcctggagtaaaggttatactaccaaatttacctaggtctatcttgatctctggtgggaactgctcgggggagaggccgaggactaggtagagaagagcaccattactagtgaacctagtgatgttgtgtgcttgagtgtctaatccggcatcctgtagagcaggtggtggggcatcttgttcgccggcccttctcgaatggctggagggccagctcttgaatatgctagcagagaactatttgcttgccttagatcgattatatatcggcctatcggctccttcggtgccttggctccctctaccaccgccattcattgcttcttgccggccctgagcaagacccggtcaccaacggcgactccgatggcgactttggttccagctctagtcttgtagctactctaggggacgacggggactattgcctctctccaggccatggtgaaaaacggggagcaggcacgcacaacttggtcgatgatgaagcggacagttctaatcagtccctcaacctcttcgctatccgtttgttacgttgtgaaagtatttccaagttggaacctgattcctaccgaaacaaaatcccgacctaccaatctgctatgcagtcaagccaccatgccaagtcctaatgtagaaccgataatcctatatcactttagacctgtgtaggttattgccaattgtacatcaaaggggttccgggtcacgcgtgatccgtctcgggaatatgctttttctcataccccatatacaaccttaataacgaaaccataaccactacattcctcaccggttcaacacattcctcgccgccaaacctacgtgtgctagacgcagcggttgagtttcgaggtcattatcacctagtggctgcactctttggctggactgtttacttactttccgcccaacaaagtggagaccgatccaccacacttgggagtttaacggataataaagccaccttccgttttccgtcatgcgccctgggctttcttcccgacaccttgttgctacgcacataatcctaagattatcccaattcaaattacacggttcatctatcccagtgaccttaagattaaattgcatctctctccgtagatgctatcattccacgtcactagtggagccagcccacacatctcgcgattatcacgcaaattcgtaaccatcttctgccaacttagcctaaggaatcatgaagcacgacaagtttggccattcgatctccctcatcgggaccatcgcactaacttcatagcggtagtcattctttcctcgctcacctctgagagaaggctgagcgttacgacgatatggtcccccacctgaaggaagtcgccggcgcgggtggtgagctcagtttcgatgagcggagccttcttgccaaggcttattcgagaatgatctgcacccgccgttccagcttgcgcaccatcttacgatcgaacaaaagaagcagccaagggttaacgaggagcatattgccactacccgtggattgacaaggcagtcagcactgaagacacgagaaggtggatagaacgagctgcccttcgccatgacaagatctacatgattgttggcattcaaaccctcattgatgcccgtatattccggacggcggttgaggaaggacaagccggaggtaaagtcaacataccagtcagtccttttcttgcaacagccaccgctaccttaccttttgcggaacttgttgaccctaccgtatatggggaacatcagagtaccggaagtggctgtttatggctcatcgctactggtgaacaagtgtgttctctacagtaccgcgaagtcaaaccgaggtggctagatagccgacgggtcaaagagccacgattatccaagacacgtcggtggttatgtatggaaggagagacacgtagggtatatgaggatgaagaggacgagaaagagaatcaagatatgatcgaggtggattttgaagatgtgaatgaattggttggagaatgggacactgtcgatactgagacgggggctatctatcttgaatcctgacggtggcaaacattctactgcattgccataattatcccttcggtttttgtatacacgatctataatagcgtgctcctataatacgattgttggtgtcgccaccagcagcttccagattcacaggtaaaagggataaattgagactgttgcttctaactagtaattacagaggggatccgcgaccctttatatccctgagaatcccttgatcgtattctcatgcgagcagcccggtcccgggctcgtaaggtccttcagatatccctcttgctagcaattgctagggatattcatatccggatgaccgaggtcatcttcttccttcaatccgtgcgatggataggatcagaacgctcttcgaggcatcaggcccgcgctgatctctcggtattaggttgatcgtcagatcagtaggttcgcgatcaatcctaccggctagggttgcttgagccgataggtcagggttctgacgatcagttccaattaggttgtagccttccaacctagctaattgacccctctcggtgaaactgatccttctaggtctgttgaatcatagccgcggctatcgtgtgattgaaccttacttttgccttcgaagccgggccggcttccacggaattcctgatattagttactagtaaattgtatatgcgttcgaacaggctgggctgcgggcttcaatgttcgtggattatctcggtagttgacgataccctcctatcgcccgcttggctccaacaacgatgaacaacggttggttccaggttattgcaccaatacattcccggtctgacgaagagtctttgcattatcaacatgaagaactgggctcacatctgctaactacacttgcagaaaaggcacctggatatctcatttttgagttttatagtccggaattacgcatctatcacgtaggactttactgggtagaccttatcggactgcactgttccgatagctacttcgctagaattttcactccctcgacccctagctctaaccctcagagtgcgcggaagacctgttgtagtcgttgtggtttgcttggcttggttgcagtcactgtggtttcttgacgtgttgtttatttcttaaaccgctgttagcgctaacttataatcgttgagggaagacagacctctttggaaaagattattcaggtttggaccgttgtgacgtggttatgatttttcattccgtttctcttctctttcgcatataatgcaaaggagtgatgatggttgcaatgaggagtgtatcatccgtctcacctcccatgcaggacccaatatataagcttacagttggagtgagtccgacgcatcgcttccagatctctgtgtctagaattaagcttggggagcttcctctcatcagccaataatcatacctcgccctattgccaagtaaatgccccaaaagtcaatcccattaagacccaggagcatcgattgtttcaatgtaggctttagcatcagctgctcacatctcaccccattgtcaaggcggtgaatatctaaacttgtttcaccgcaggcaatggcaaggtaatatagataaatgcaagattttgtttctgttatctacttgctatgttctaaactcttattctcaatagttggcccacctcaagtagacgggacccattgtcaactcaacgacagccaaaacttcgcataaaacggccacccacaaactagaaaggcaaaggtagcaaactcctatccttatgctacgtaaaacccggacaaatcaaccccatccatactcccagtatatataaaatatgaaatcagtattgtcgactatatgatgctccttcactcagcaggcgactccataaattagtgtctcggcgtagttccttttgtgaacggcgggcaggggtcctgcttttccacctcgacgcctatcataatcataaaatattgtcgtagtactgtaaaaggggcgatggagaaaaaagtatggacaaatagaaaagtagtgtaagcgaaagaaactgatccaagtgctgcgtcgataatgtacaaaacaaatacaaccgggcaattatatcgaggtccgatcttggtttagaatgttgtaagaagagggtaggcgtagtgattaagatagcctgccgaagtctatctcgttgttcatagagcccatgccagggatgccaccttgcggcgggtattgttgccgagggtcatgcatgttgaaactggtttgtctctgtgtcggttgcctcattcccaccatattgttcataggcatagacggcgggacggcttgtgtattcattggctggctgtgcattttttgtggcatgccacccatgtgatgttgtcgcatcccctcatgtcctcgatccatgggtatatgcgggtgctggtgctgcgtttgatgctgcgcgtggttcattgggtttggttgtgctaggtggcccatggggctcatcaccatatctgacattggagtacaggcaaaattgttcatgccaggagggtactcaatggtaggtgacatgattccaggtgagctgacgaaagagctgcatatatcagagcgctgaggtgcagtggatgggacaccgttggggctggtgttacccactgattccggtgtgccggtgctcaggtccatcgcgtacttcttgtcatattgctcaacggggaactttttgccataactatacaatcaatcgtctcacgcgaaagggtctcatgccaaaatgcctcatgccaaaacgtctcatgccaaaacgtctcatgccaaaacgtctcatgccaaaagtcttatgttaaaataccccatgctaaaaagttgcataatgaaaagtgccacattataatttaggaaatattggtaatatacgaagtacgcgccaataacatacgtgacggaggctcagaaataaagcccgttttgtatttttttaccgcgacccctgaaacaaagtcgtcccaaagtgtcaataaggacggcgcttgcgcccgtacgtagcagataagcatctctgctttcagagctgcatctgagacctgttgcagctcatcgccctgtgcggtgaaggctaggacgacttgctcttacacattacgttggaatgttagactaagatacaagctttgcttataaacagcctgtagcaatagttacagaaaaacgctcaaaaataaatatattttaattcgaagtggaaacggtgccttaggattatgagttgctattagaaccctaggcaaatgaactaagaatgaagagttgccaattggaatggtggcttgtaagtgagaaatgaaccctcggcggttctccggaaacaaatctgatcatgttttgctagatgcaggggcttacttatacacagggtaactggtaaggcattgtagctacttcccttgctctcttccaatgcctccacctttacttgatagctatggagtggcgcgtcgcgcgagaatcctgtattaattagatttaagtacttaataattagtattaaatacgtaatattaaatattaaatatctctttgatatggcagaagctacgagacgtgggatgatatcctaagctacctcaacattattcgagatgcagatcgagagcaggtgtcatgcagtacttcaagcgcaaggagacgcagagggcagaagaagaagtccattgacgaagaagatgaagattacgaacgcaaacaagtagaaacagaacagtcaataggacatgtgtgggataagatatacgagttagaggagttacagtctgtgcagggttgcaatactactatgtccatcctcatttttcttttaatgccttttgattgagcaagcaattcttgttcctcagtcccacgtatagcgcatgatccttcaagtactgatgagtgtagggcccgctatgttccactcgacgtcgcacctccaatacaagtgcttcgttttgtcttgaattcagataccgcatcatcaagagatttgtcctatagcgggctcgagaagtcatacttccccgcaaccccttgcttctcaaagatgcgttttatctcgccgggagtggtgaaaggaaacagtttccagacggaattgtctttgtagaacttggggaaggcgatgtcaagcagatggtgcatcttaccgccgcgagcgagcttgtcttgcggtttgtctggcttgataatatcgaacccccagttcgtcattgtggcaggcgtccagtcctgtttagagtcgagttagttaaggagctgctaccaatgtggccattctgggcaaacatggatatggagacaagggcgagcatacaagtgtatagaatcgatcacccctaaccaaggtaacagcatcgctcaagacggccctaaccatcgtgaagcccccgcagagtcctgaacctggatagacaggttccttggcatgctcgaaaagtacgccggggtacatttctacaaaatcaggctctttatagagggccttcatggcctcctgtgtcttcggatcggggttaatgtcctcgaagctctcgtgaggtttaaggtccatgaacttgcgcagctcatttagcgtgccgacgtgccagctgcgagcctgactgataccaagcattacgacgagcctgagcacgacaggcacttggtgcgccccgaaagcggctgcagggttgatgtaagtagagcgctaaggtgggtggaaaggaggagagcacttaccgctaacatcatttgtactctccgcgatgagcttcgctagggcctgtgtgtcgaagaaaccggagctgtcgcgtttcaagcctccaaaagtgcggcactccggtttctgggccacaatttcccccctcaatttagacagccctgtaaggaagtctttaagaggcagtttggaaacttcctggcctgggaacagcttttggaagaagtcctgagaccatttttcgtcttttgcgctaacagtggaatgccagcggtagatgaggttgaactcaaccgagacctggttgccagtgctcacggggaaactgcccttatcgaagacttcggagaaggaccttcgcgggtccaggacccaactagaggcgggagcgtagttcatattaagaattgtctttacatagtcggagaggatgatattgacgtagaggccgcatgtcacactgatagcttgtcagcaaagcaataccctaaccttaaccttgcgcaaacttaatacgtacagtcttgcggtgttgaagaggcgtttgtcaacctctctctgtgcatcttccttgctcagccgtggattcggactgaacctttccccctcgttaatgcgttttagttctcctgctacatagttatggaagcgattaaatgtgatcagaaacgcggagacgccgggcggaaagcccagaagacgatgttcagagaaggtgtcaggcttgagcaagccgtctttcatagtgcgaacagcttngctgtagccactgacccacagtggctgcagccgctattggttagtgatcctaatcgctatcggatagcgatctcaatcgctattggctagcgttggcagggggttattagcgattgtagccagtggctgcaatcgctaaaggctagtggttgcgatagctagcagctagtggtcaggatcgctaacagcgatctgaccccactaacttatagtggctataatctctcaaattcaacaattataagatctcagctgctaaatatattatctagagttaaaacctttagctttatcttattaatttatatctggaaattaagatctatagcttttttctctttagcttacttcctattcttttctcttaaaatctctagtatagatatttagctctagttaatacttaagagaatacttaagataatactattattataaggtagttttatatattctaaatccaggcttatttaattaaataattatataattctattatattaagaatttatcttaatatctttctataattctattatctaactaaacttagaagtagctatattaatattatttaataagatagttttaggcagcttaactagttactttatacctccttctttagctaaaagagagaaagctaaattagtaaaaatctaacttaaaagctagtatatcttattactattaagaacctttatatatttaaataacctatctccctttatttactaggctaaaataatagattagagtattttaaaggcttttctactaatagtaggagtattcttatatatacttattttactttattaaaagatatagagtctattatacctattattcctcttaataatctattagttagaaataagctttaagataactaccctatatagaataccctatctaatattatcttatagggaggctagattaatagcttattttatcttagggaaagtagaaaagcagaagtatttactcctaataataggaactattactctactttttttcttagtagctttaatagtaaaatttataaggctaagtttactaatagctactactaaaagtatactatagacttcctgctttaagtaattatttaatccctagagtttctattaagaaattaatattctattaattatttctatctttttctatttaattatatatttagatcaaatgcgagaaatagttaagagctgccggattaacctttaacctaataaaaagcgagcttatatactttataaagaggaggaaaaagataaagaactggatacagaccggagatatacaggttaaactatataaagcagttaaattccttagtatatagctggacagaaaactctaaaagaaaatatatataataaagctctaggagaaacttaagagatagatactagctctaaccggaattatattatttatatataggtacttatatagataagtaagagtagtttataaagttactataagatctataatagtatatagagtatctatcttctataaacctatagagaaagggagtaaactatagagatctatatagagcctggccggatagtagttaaagtgcctccgggttataactggggtgttcagagctatactactaagaatagttaaaatagaagtactaatactacccctagacctctatataaataaaagggtagtagaaatagaaaagagatttaaagctggaaggattataaatataagccagattatagttagtatagtagttaagttaataataaatcagtagagataaaggctttaaaaagtaaagctactaagggtaagctggtattaaagataaggaaaagactttaatttagaagctaaatagagaattagataggaaactaaagtaaatataatatagaggagatctagataaatataagcagtagatataatagttagatttaatagaggggtacttaagagatataacctcctgtaaaaatataaaaactcccttctaatatagataaaaatagggagaataggcttagttttttttctttttataaggggagttcctaaggtgaatatatctatatattaatatagagaaaggaaagagaatatatattatattatcctatagtactttagatttaaaacctaataagctgagctaagtactagaaaactaatatagatctaatataatcttaatattataacagactgaaaataaagtatataagaaattataaggtaggttttagatctcgggatactagaataatataaacttactaagaagctagatatactaagcagaatatatagaaaccccaggtagaatttaatctatatataaatagaaaatatattagataatatctaaacccagttaatataaataataatagaactattatatatagttaaataggtataaagagaataaaaataatagaaaaaaatagagtattagtattaaaagtataaactaaagactctaagctatagaactaattagaacctagggtagacctagggtagaaactaatctaaggctctttagatatattagtattatagctagtagtagctctactagggatatactccttaaatctgctataactactacctttaaccttactcttactaaatatactatcaggaggagatacctctgtaagggtattaaggatagtctaaactaattctaatataactatagctataagggccaggagtttatataaaagctggttctagttaaggatatttcagttaaatatatctaactaagtactaagggtagttatctattagcagttcttcttacccttagtctctagagtagtaatagtagtcttattattatatagggcctaggataaaaccagggtaggactagtatagctgctgagggtagtagtactagtataatcctaagtactactagaggtaagaatatagacagacttattaggctagtaagctataacctctgaaataagtatattctaccgagcttactataactcggattagaatagaagctaatatagaagagtactaaatagggatataaaatatatattaaattccttattaccgaaagtaatattaatagtataggtctataagtttttggaaggtcaaggcctccagtatagggtagaccagctatagggtaagctgggtctagggtaggtacagcctataggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgtttcagggcttttggagccctgaagataacacgttgccttctgtaatacgggctcgtaaccgctgtaaggttctcatacagcggatacgaggtccgctaatacgagtgctacagcagacacgaggttcactaactaagtgctaaggttctcgtacagtggatacgaggtccgctaatgcaaacgctatagcggacacgaggaccgctaatgtagctgctacagcggacacgaggaccgctaatgcagctgatacagcgcaatacgagatcgctaatacggtcgccacagcggccgttacagcggttgtgaccgctaacgcaattgccccaaagggcagccacagcgggttgggccggtggctccagagggcttccagctttggaaagccctaagttagttatttcattccttcttaccctatactaatctgatatcacttgatcaactggtatagggtaatctgatctaccctatagtctatagggtaaatctcaacataagtaagtagtatacttagcagagggataattaataggatactatatagattagaattagaaaagactaggactagatatagacttatctttaaatagggaaacttaaggctataatacttatagtagaacttagactgaagacctactatagggttagtatagaactaatctggaagtagatagaaaacttactagactagagaatataataagtagtatatctattagtagctatactattaatatattactagtaactagtcctaggataataaggactagaaagagctagaggctagactagagataaaatagaggaggaaggaataaactaggtttatatagtagtagagggtagagagtaagataggatagaagaagtatagaaataatatagagtaggatctactccggatcttatttatattagagttaatatagagaaaggggggaacttatctaattatctaattatataaaaaagaaagagaaaaaagaaagaaaagaagttagagggaaagaaggtatttatagatataggagagagtataaataatctaaataatctgagaatctataaggaaaatatactagatactaaaaagttatataagtaatagtaaatatataaggaatctatattataactaatctgaatcagtatagtaactatatcttcctaccctataactgaaaaagttaaatagagaagaatataaagttaaggaactgaactagagctatactaaatatatatagggaatagattagataaatagaaaactaaagataataaagaaatcctatctaaataacttctaaagagaaaattaaaattaaaaaaaataaggctaattaattagataactggaaaaataccctctaaattatttatttaaagctagttataagaagttaaccttaaggtagagctaaattatatttaatatagatataagttaaagactaccctatctatactaactggcagataagagctaagatagaaatatagtaaataaataaaggaagataggaaactaggagctatattagtatctagataaagctataaaggaaataagcagaataaggtttttattctatataaaaggttttcccttattagagattagatagagggattaaagactagctagacctagtacctagggtaaataataaataaatatatttagatctcttaataataaattataacttctttagtaagaatctatactaacttctaattattatctaaagggaaaataagtaaaaagatctatataaattactatccttttaattaaatagtcctactttactatagtaaaatttatatagtatatttacccttataaatatagtagagaggcttattatagtagctctatatttagtctctctcctattaatttaactatctatataataagctatactaatcttcttattaaagaggaaactagcttaatagtagttttttttatttatcttaaagtagataaatcctataataaattattaatctttagtttttttctagaatttcttaatattctaaaattctctttagtaatttcccttaactaatatctagtctttattaaagtaattatatttagctattatataataaaatacaggggttatatccttagttaaattaatttctaaagtagacttaagtctagtaaaataacccttctttttatatagtataatatttagtattatattaagctctattctatttaactattattttcagtatattataataataaagttatagatataaactaaatattatttataagctatagtctttcttattagttttaatagctagttcttattagtttaaaaacctttctccttagggatttctattttaatattaagcttataaatatatttaatatatttattagttaatatcttatttactatagctagctagtacttataaggttaatagaaagcagagttatcttttctaattataggaattatagctatagtattcttaaagtatatctccttcttaattagaaactactccctagggttagatattatccctttatagtagtagaactttattacttttatttaattaaataaagctttaaagaataagagtttaaagctagaatataaaaggtaaagctagtaatatatagatagtaggtagatatagataaataaggtctaagtttttaaaatataataagaagagtaatttataaaatagtttatatatagattaggagtaaaatataagagtataaggagataaaaagaagtttaagaagttatagagtagaagtatctatatttataaataaatccaggagtaattattatatataattactctaagtaatatttcttaatataataatctttctatatcttcctcctttaaaagttagattatatagataatttaatatatttttaagtagctcttttctctccctttatactatatctttttatttttctttttctcttcccctttaattaatatatagctttctaagcctagttagctatacttacttatcttcttagtttcttagcctcttatacctatataaataagtatttttctttccttaaggttattttactcttcttagtttattctttttcttaatctctctcttactagctgagcctacttctaattatatcttaacttttatatactacttcttctttttactagtaattctcctaactattccagactattatagatatatactaactacttaattatttaatagtaatatctttctttaaaggtaaatcttattaggatatactagagatttctaatctgattagataatatattaatctattactctttatagttttatattctattaataaagataataaagctatttttcttctattcttagaggttattagttctagctccttttatctcttttaatagttttttaatatataatagtatcttaatctagtatataattctaatagctttcctatatatactaaaatctactattactctaattctttatataatatttaaaataataaataatttcttaattaagtagaatccttctaaataactatagctaaatattataataactctactttatctactatttatctacttattattaattcttaattttactaattagtttatattcctactaatctaagctatttataatctctctttcttatttatcttatagcttctaaatagtatttaaaggtatttcttattactctttatagtcttagaaatcctacttcttattagtattatttatagaatcttataagtaatattaattatctctaaatttatataatattcctattctttagctatttttcccttcctagtacttttaataggaagtatactaactactttttctatacttatagtaactatagctataagttcttaaattattatcctgctaatactactaaggaacttatagattctaatctttttataggaaaatcctttaatattatcttattatctaagtatattaatcttttctatctaagaacagctccttaggttactaataactagctaattaactaggagaagaatattatatctaagtataaaaagctctaagctttctaagaataccttaaaaaagctcttaattctaactaggttcctaggaagagctttatttagtaccttttagctagtaaaattactaaggatcctaactttagatttcctaatagtttatattctaatactttagaatattctaaggtttctaatttaacttaattaattagttatctatctccgaggtagtttctatacttatatactttatcttttctattatttaaatactctagttttctatagctattagatataatactcttcttaagttattctctatagctttaactagttaaattaaaccttattataatttttactaatttttaattatatattttaagtattattatatatagtatctatatattatatttagtattaggcctattatatattatatttagactatctatttctttatctttctatatatctagctattttttagattattataattatttaattagctattcttagatctatctagactgtattttaattatcttaagtagtatatatattcttttcttattaggtagtttatactctttcctttcttagatatatactctcccctctataactctttagtatatactttttagctaatctcttactatagctagtaatagttctatacagctaaagagagtagataactaatactttttatatatttacctgtttttattatttagactgagtatctatatctctagtttctatctataagaaacctaggactaaatatctacccctttagaaatactttcttttttatttttagacttttcagaagaattattagaagagctattttcttaattaaatattctctctctttattttaactctaagggttaatagtaatataaaattaatatagagtataaattcttttctttaataataaactactactttatttaattttaaataaagtattttattctattagatataaatattcctttaatataaatattatctaaggtctttagagttatagcttttaaataattattctataagattactttataaaatccttactatttagcttttatttttctattaactaatttattaatcttattccttataatattatatataagaactaagttttctagctagattagcctctttctaaatatatagtaatttactttattccttctttttactagattttccctataaagggatactctttctattaccttttctatattagctatatatctttaaattatctatatttaagctaatagtaatttatagcttattattacttagttctaattaattaattactaaatagagtagttaatctctatagggagtaaagtattatatctatatataagatagaatagggttattctatataatttcctttctaatactctagttataaagagtatagggcctaggaatcttttctatctctttttagaatatactattttagctattatattagtaataaactagtatcctagttctataactctatttatctttaagttatagcttaaaatctaaattctcttaactctaactcctttaaactatattttaaattctcctttattctctagttccctatttattataataagaaggataattctatatctctatataatctcttagaagaaggtctttatctatttagagttatatttatatatagcttttacttccagctatcctaatagattatatctagcttataatatatagaagtagctcttatttatagaaagatatactatattaaaatagactttaactattagatagcctggagaaatatatctagaaggattcctttctagctatattctaaatagctgataaagtatatagctttttatagctttatagatatctttctttatttctctctactactagtttcagtatatctaattatataatacctctatatctttatagtcctattccctatagaattagttaattaaatccttttaaatatctagatcttctattatatatattattttaaaatagtactaatttagtttttactatagtattctatataagaaatagaaatatttagcttaggtttttattcttctaaattctttattatttactactactagccttattagagttattaaatattcctatattatctttataaagttatttagcctattcctattactctttatattatactatagttctttagagctatttactattatagttataaattagtttttaataaagttatctaaatccttttccttctctttttattataagtctttctctataatagatttccttaataatctatctataatactattcttatttcttagaatatagtatatagtaaaattaaaaagaaagatatagttaatctagtatattatatagaatttagatatattattaattactctattaatttaattaattaatacctagatattagtttctaatataaagtatattctatatatatagtttcttaattatctaaaggtagaagtaatactttaatactctctctttattatattatatcttacttaagccttattccagatactagagttatactgaataggatacctctttctattaataatctatattaagactgctccccagcttataaagctagtattaactataataattatctctctatatccaggggatatatctaaagatataagaataggggattctataacttttacttttagaatctctagagccctatagtaagcttctccctaattaaattctatatctttctttagtaggtttataagtagctaagatattagtataaaatcttaaatctactatctataatagctaataattctaaggaaagatctaatatctaatatattattataatacttctattatttaatttttataatcttagcttctttaggtttttagctattagtactataaagaattctaataattataacttcaggctaatagaattttaatttagctaaagaaattatataccctaagagcttaatatttaagagtatatagtctagattaattaaatatttatagatatatctatatatttctagaataatttccttataattataataggatatagaacctttaattataatattatctagaaagagtttataaatttctagtataagtttactaaggattctaaggataattcttataaattatactactaagttaatagttccttatagaagtatatatatttataataattctattatagttataaatatagttatatttctattttatattactagaagaacttagttatatcctaagaagaagtttactatacttaaaataatatatattataaagtcttctgagaatttattagtattcagaagtattattatattcctaataataaactttgttaattttagagaggttatagcctctataaattagtggggttttggctgctactagcggttataaccactaactgctagcgatcttagccactggctattagtgatcaaattagctgttaaagaccgctattagcggtcccagccactggctgttagcgattgtagccactagctgctagcgatcccagccactagccgttagcgatcccagccactagctgctagcgatcgtaaccactagcttctagcgattgcggccactggccacaaccgctaataaccccctgagctgatcacccctatctactgcgcccatatgatcgttataatcagcagctgccgtcaagacccgtgcctctttgacagcctcggggccaaagaactgcttaatagctcgtgcccgtgtgtgtgttgttgtgggccgcttacggatacgtgccgtaaactctgtgccttcgtacacagtggaaagcagcagcacaagcgcgttatctttccaagcaatttgattgacctagaaagctgttagtagggggtttactagggaattcctttccggcttgatcaaccttgttatctggcgttggaactgtctctatctgaccccacgcccaatgaagcctgccgcttgtatcatccttctttagctgtataagccggttgaagatgctgctgttgatacggcacgtgccggttgccccgatgttcaacgctcgtaggactgtaaatagatcagggcttgagaagaggttatccaagaagacgtgatatatggctggcggcagccgttttactaggtcaactaccacagcctgtgtcaggttgaggctgtattcatcatgccttttcctcttctttgtacgaggcttgttctgacctacagagtcaaacaccttgtgaggcaggtgcggcagccacgagaggaaatagccggcnnnnnnnnnnnnnnnnnnnnnnnnnnnnnnnnnnnnnnnnnnnnnnnnnngaggcaggtgcggcagccacgagaggaaatagccggcttcagctacagcccagattttgaacccttcaggcgtgggttttgtagggataacaaccttctcaagggttcttccttcaaagtgctacatacactcatctatagctatatttatacctggagtccagtatcgaagggaagctgcttgtatagcctctgaccattcaagaatccggtcaaaagagccgtcataagagcccctcgggtcataagggcggaaggcacggtaaatctcctgaaaggtgttgaagctcataaattgtgaaatagggtgggttggcttcattgaccccggcttgtaggtatcccaatggtctcggatacgcttttcacgatgatttactatataagttagggtcccgagcaagagatatacatgatctgaggagatagcctagcattcatgattatcagctcatatctgtgtatgtatggctgcaagagctgttgcaaggagccctcttcaaagctagctcaataacctacttttttggccggaagcccgtaattcgtgccccagagcgattcctctggaaccaggaggcggatggtaatacaataatacccgacgcgcccgagagattccgctgcgtctgggatcggtacggcaataatgtgtcctttgcctgccagatgcagtctcttctggccgggagaaaggagctctggactgacgagcaagttcgttttgctgaacgttgccagagtgtcacttggggggatcttgtcggttttgggccgaacccgaatccaaagtggcgtctgaacgtcaccggccacagggctgtgatggacgacgtagaggcgggactcttccacctaatggagctagaagtgaaggttttcaagcacgatggcgaagcggtttacgaaaatatcagtacatacttgggagagcgtggcatcgtgttgtgtcataagcaggagccaaaaaccgtaagactgtttcacgctatgggctatgataggagtcaccgtctggtgcaacagtttggactcgagacctaaaacttggtcatcagtgtccacgatagagttcgctagaaaatacaaaacttagcaaaggttaaatatacttacgaccggcttgtattccgttagaaatcgagcgagaaaaatacaaaacttaggtcaggttaaatgttgagttatgcagattgacttcggctccgggatttggccctccaagtctaagctgtggctattgagatgtggcttgaagtggcgcattttgtggcggaggtggcggtgtcccaggtgttactttcgagggggcggaaggaagagcctttcgttcctcaaggcacaggagaccggtcccctccggggcccgccaatgcctgaaggaacgaagcacacatgcaccaccttcggtggcgcatcaaatgtggctccctcagacgtggctcctcggatgtggctcatgaatgatggcgcatgaaaatgggcttagaaaagctcagctcgccgagcgagccgtgcgtggagggggaaggagggcgcggaaggaagaacctttcggaacgagactttccaggctgcggaaagatggttgttgaaatcaagatgacaagatgactattaaatgaagagacacaggagaccggcccttgcaggcccgccactacctgaaggaacgagtccttcccgtgagttgttgaggtattgcgagaattatcgcgagaaccttcacgagtgtggctggtgaaggcacggaccatcttgtgttttgagatcaatccaagttctggatctagcgctcggaccaggaacgggaaaacggggaggaaaaaaaaaaacagggaaggaaagagaagaaagaagagaaagagaagaaagagaagaaagaggagaaagaggagaaagaggagaaagaagagaaagaagagaaagaagagaaagaagagaaagaagagaaagaagagaaagaagagaacaacaagtcactaatcttcatagagacgtctcgtctccgcagccaggcttttgagtctctgcaccgcatcgaccatggcctggtccagcttgttaccaaggaaatcatgggcccgcacagggctgagaagcttgatccctcgaagcgtcgtgcacctggacaactggacgtagaggctggtaaaatcgcacttggagggttcgccattggtcatgcgatttccccgcagctccaagagcacctcggaaaacgttttggattgggacttatagtcagtcagaacaaatgccgggacaactggtagtccccgtcgggtgcacttcgtagataaaaatttgaaatgggagtcagttggatcgatgctgtgcgagatggggcggatgagtactagctccgctgggaggacggggaccgccaaactcgccgtctccttggattgtaataagattcccagcggtggaccgaagtgtatggtgacgtcgtccgcaagacagtaccccgggtatttcggatcgggaatgatgtccgccgctgtaaactctgcgccattgacaaccttcaagccagtgtacatattcttgttgacaaccacaggcatcccttgagcatagaagaagatgcccgggaccttgcacttggagtcatacccttgctccatcgcctgggctatctcatgttgagagagagcggcacttcgccacctatgtgtagacacgaagacggagatgtgcctcccattaaagcgcgcccaatccacgacggcttccatattaaggctccatcggttgcggttcagaggtgttatggcgcgcaggccgttcctgaaggtgatatgggagcggtggaccagtttcgtattcagcaggtcaaggtcttgccttgtctgagtgccgtgccgtactctgtccagaagctcacccagctcagggtcgtctcgtgcgcggacctgttcctcgagaagaacgacggtcttaaacattagccacagactgaagccgcgatggtgagaaatggcggcttgccccgccgacatgatgacgggatccaccgttcggtctaccaggaggctcgtctgccgtactggggcgaattgatagaaatcccccatcaaaagaacgacgggaataccgctaaagggtttatcagggcagtctctgagcgactggaggcggcagctggcctcatacagggtagcgcctccaagcatgctaacctcgtcgatcacgaggaccagcttctgcttccacatccatttctttgcctcggagaaaagagggagttgtttgtcggaggagcgccgggtatccaatccacaggctgaatgcaacgttgtgccaccgatatgtgccgctgcgctgcccgatgttcccgtgatgcggagaagatgcgattggcctctggccgaaaagacccatttgagggcctcaactaccctggattttcccgtaccaccggggcctccggtgtactggaagtgttgaccagccgagtcggggtccgttgcgtatctatccaggaacccgcacacaagttgaagagccaatgtctgcagagtgttgagggtatagttctgcgcggaaactcgtcctagttccgtgaagctagatgtcttgtcgacatcgacgagcatccgaggatcctgtgcgtcggcgtctggacttcgatgcagcagcggaatctgaatctccgtatcatagttacgggcaagcacgtcgtccatatcggcgttgggcgtggtttgtgtgccaccctgtggacctgtctcaatctcatctagcatccggagatggagcatctcctgggccttcgcaaccgcctgaacatcttccacggaaagggtctgacattggcacaggggggcgtcttggctacggcggagttgctgatagaagcgctcgggacgctggaccaagggcctatgctcnnnnnnnnnnnnnnnnnnnnnnnnnnnnnnnnnnnnnnnnnnnnnnnnnntttgcctcggagaaaagagggagttttttgtcggaggagcgccgggtatccaatccgcaggctgaatgcaacgttgtgctaccgatatgtgccgctgcgctccccgacgttcccgtgatgcggagaagatgcgattggcctctcgccgaaaagacccatttgagggccttaactaccctggatttgcccgtaccaccgggacctccggtgtactggaagtgttgaccggccgagtcggggtccgttgcgtatctatccaggaacctgcacacaagttgaagagccaatgtctgcagagtgttgagggtatagttctgcgcggaaactcgtcctagttccgtgaagctagatntcttgtcaacatcgacgagcatccgaggaccctgtgcgtcggtgtctgaacttcgatgcagcagcggaatctgaatctccgtatcatagttacgggcaagcatgtcgtccatatcggcgttgggcgtggtttgtgcgccaccctgtggacctgtctcaatctcatctagtatccggagatggagcatctcctgggccttcgcaaccgcctgaacatcctctacggaaagggtctgatattggcacaggggggcgtcttggctacggcggagttgctgatagaagcgctcgggacgctggaccaagggcctatgctccgaagctgaagcctcttctcgcaggtcgcggatgaaagtcatcaaaactggggaacctcgcgtggcatcggaatcccgcactgcgttgtgcagagtatggagcaccgctgcaaaactctggtgatgctcagccgttatcgcaggcaagttattatcgtcgcgctcatcaagggggaattctgcatcgactgtgtcgtcgccttctgatcggttggcccagagctttgcgtcccnnnnnnnnnnnnnnnnnnnnnnnnnnnnnnnnnnnnnnnnnnnnnnnnnnacgtagccggtgacagagagaagcttcgtatccgagccataaatcggtaacatcgccgtgcatgtcagaaaaaaagcgttcccaaggcacgaatagggccagatggagaacagagtttctggacggaaatgtgagaacaagcctcggggttagcagagtaagctcagggcataccgtttgaagtacacagggtgctcgtcatggtgatcgtcgctgataaatccttgaaaaatcggcacggcgtactcatgaggtcggcggagcttctgcaaccagccatggcacgccacagagggcccgtcgagaggtgcgagggatatgtggttctcattctcatcccggccacggctacggaccaggctaatcatagacatgtaatcgtagaggcatatatttgtcaggacccggcccctgcaggcataagcatccaggcacaacagggtccgcccaccttccctgagctgtaccgactctgggggcttctcggcctccgtctctgcgccggcctggctccggagatgcttccatctgcggaagatntattggaagcaatctcgacgcttttcgcgattctttcacctccttgtgtaaagacagagccatcttgcactcgcctaatccgcttgctcaccttactcatgaaggtaaggtaaaaaaaaaaaaaaaaaccttcgctaaggtctgctcctctaactaggtcgcagatttctaaaatctcgctcttgatctcctttcccttctacgaaaactccttattattctcttattggaatcaaagacagccgcggccctctctgaaatgatctccttaaactcatttccgcggttgcctccgatgagttcgattttgaccacgtcaaacccttgttaaaatccgcgctcgccgatgagttagacgatgccctcacctggaatcaagtttataacgctgtcattgaatccactccacccccccgactagtagcctcttccatttaacaaactccatggctgcttaatacaagtagcttcgcgaactcgtccgaacatcgcaaatatgtggatggggtccttaaggaggagcttggcctaatgtatgttgggcttcgcagcttccacgttttgggtaagtgactgatcttaaagataacatccgaggcattctttgaggtgtgccaggaaggcggcgacccgctctttgacaacggctggacgggatggccaaaagatgcgaagcaggaggatgtgctaagctggtttgcagactttagcgagaagctggctaaatttgcagagggaaagacatcagcgccggcacgtcagtgaagaccattagcgaaaccggacgatacgatcgatggctctgtaggcaaacgaaagatggatgttggttttgtgaatgaccccgaggctgggagggaatcgagataccattggtcccatgtccttatcccaggagagctcaagagcaatcgcgccgctgataaagccttgggagcatggcttgatcttgggaggtacgcaagggaagtgcttgctgcccaggacactcgtcgctttgtactaggctttaccatttgtggatctcgtacgagggtatggacgtttgaccagcttagcgccatcgcatccgagcagttcgacattaatgaagatgggctgcgatttgtatgcataatccttgggtttctctgggtgaacgaggagtagctggggtacgatccgaccatcataacagtgaataaggagcgttttattgaagtcgagcgataaatcacctaagggtgtgcacacactgggatgggagctctgtgaacgagctaatgagtttcgacagcttcgtgagtccgcggcgctgagggtgccgcctcctgcggaacaggatgcccagtgccaggctgtggtaaacgagagtcgtcagtttctgatgagggcagcaaaccgaatattttccgagagacagctttccgccgtggaggtctgctacttcttgcttggctatcaaacggactttacaaatgtgccgcactggtcctacattaatttgacggcactctactggaccattttccggcgctgggcacacctccgtcgccaggccagtacgcaaactgattccgaagagccatcagagactgtgcagtttcgggaaaatggccggacactattgtacctggatgcctacgcctatcggggcctagttctgagggacgtgtgcctctatgactatatgtctatgattaccctggaacgccgccgtggccgagatgaagatgatatccatatagctctagaaggtcctccagagtgctgcggatggatccaaaagcttcgccaaccccccgagtactcggtgccgatctttcagggattcattagcgacgaccatatggacgacctcccattctctcattggggtatccaatggttgcagcagtccttggtagggcagtcttgaggctttggatcgagaacaagtgcagcaattgcgaatgcttcgccgtatannnnnnnnnnnnnnnnnnnnnnnnnnnnnnnnnnnnnnnnnnnnnnnnnncacacctccgtcgccaggccagtacgcaaactgattccgaagagccatcagagactgtgcagtttcgggaaaatggccggacactattgtacctggatgcctacgcctatcggggcctagttctgagggacgtgtgcctctatgactatatgtctatgattaccctggaacgccgccgtggccgagatgaagatgatatccatatagctctagaaggtcctccagagtgctgcggatggatccaaaagcttcgccaaccccccgagtactcggtgccgatctttcagggattcattagcgacgaccatatggacgacctcccattctctcattggggtatccaatgrttgcagcagtccttggtagggcagtcttgaggctttggatcgagaacaagtgcagcaattgcgaatgcttcgccgtataccttggcgcatcctgggccagtaataatgccttgccagaagcttgtagtgtttgttcttccagggtgtccagctgcgacgtcgccgtggcaagatcgtaacagccaggcgcgtagatcttcgtgctcggggacgaacaataggatatacgaaagtaatatagctccctatacagcctagaaatccagcgaactataccgcttattcttgcgtcatcgaatacccctgttaattttatttcctacttgatctctttgtttttggtcgtgtaacgtcagtaaaaaaaggcttctctgtttcagaatcggtggctggctcacgcctcaccattggcttgaacaagatcatccaatttcccaatactctttctagtttgcgaagacgcgttttgattctgagtatacaaagatagctgtgcttgaacatgtagtatattttattttgctgatggcccggaggagaacaggcatgtgataccggcactcatctctcacacagagacttcagtataaactgccggtagccgtttatcaacaataatttcacaagactaatgtacaacagcgcctgttcacatcaattccggcgcacgaacggccatcaaacgatggatcacacaatggtaatctagcacttgatcatactctctgattgggcacatttcagcttacgtagttttaggctatgaaggttgtgcattattgtaaaacacaattgcctcttttgtagcaccgcgagcgaatgagacaaggggatggctcggaccgctccaatctcggccaccacagcaacacaacagcgcaaagccctgcgtggaaatgcggcattttccctgggaattagagctttagtaaaggattaattcccgggatggggatttccttgctttcaattcgacgtttccatggcggagagacgtttgctgggcctttgctaaccgtgcctttccgcctatgccgagatcgatgcaatttaactccacgggtcccccatttttgtccatcccagcaattccttctcgctttttcttcttacgcactgtttcttgatccaaaagctctttgaagtgcaggaagggcgcgttgtggctgcgatcccgagctcctacgagacctatacacaactcacacgctttgaaggattgaagctgtcacgacgtgcggagtcagaacaatgcaacgctacgactggcttgcacgacccctcttattcacacacatccgagtcttgtaagcaatgtctcgctttacaaaatggtcaattctttttttttcgtacgtcaagacaaatttttacaggaggtagcggtatccgggtgccatatccccaaggtcctccttctcctcctgcgtgaggttgtcgtcgcccaactggctcttcttcttattctgcagcatacacgcggcagcatacgccgccaccgcaatcatgctaagaacggtgaaggagatgcagatgctataaccaggaatatacttgggcttagccgcatcggtgaagctgaagctggcgatgatgccgccaatgtttccgaagccgacctgccaggcggagccgatggagcggcggtggtggccacccaggttcatgttgaaccagcatacgatgatgggcatggccgtgtacgcgcccgacgcgacgaggaagagtgcggcgtactggacggaggtgttgttgtggaccgcgatgaggattccgaagccggcgatggcgatgcagatggcgaaaatggcgaagccgaagcggtggcgcagcttgtcggagcagacggcgatggtcatggagaagccgaaggccacggcccagggggggacgctgtgcagctgggtctgaatggaatcatatccatagccttggatgataccgggggcgaagtacgcatagctgtactataggtgtgttagtctcagagctcgagattttgcgctggcggctaattgaacttacagcagggacgatcaggccaaagtacatgaagcctccgaggatgatcttatagtccttgaagacgtttccgacatccttccagccgacactacggtctcgtccggaagaggactggccctggtcgattcggagacgggtggtgacgaactccttctcctcagcgttgagccacttggtctcctcgggaaagcagggcaggaggaagtacagggcgatggctacaatgacggtgagagcaccctcgaggatgaagatccacctccatcccttgtatcctcggagaccgtccattttaccgatcgcggcggccaataacccaccgaaggcaccggccagggtggtgctgttgaagaagaaggagtagcgtctctgggcctcgctgcgcttgtaccacattccgatcaggtagaacgccgcgattctgttagtggaggccacacggtttattcattcgctgcgcgacgtacctccgggaaacatgccggtctcgaagacaccgaggaagaagcgggtggcgagtaggccgctgtagttcttgacgagaccctgcagcagggtgaccaggccgaagccgaacatgttgattgagagccaggcactgttttggtcagcaatttgccggggctgtaagcgattgaagggcttggattgtcggcttactttgggcgcagcttcttcagcagcaggttggaagggatctcgaaaaggatgtatggcacgaagaatatgaccagagcggtgttgaattgcgtcttctcgagtccgagctcggtcgacaggccgaagacattggcgtttgagatgttgacacggtcttttgcggtctgtcagcattacgcacgttccggacgactcgctttcgcacaaaggacgcgcagagaaactcacccaaaaaggccagcaggtacatgatacacaggaagggcacgacatggagatcgatcttggtcatgaggcggcgctcggtggtgtgcggcgggcactggacctcggcgacgggagcagcgacagtcgcgccgacagcctcctcggactggacatcgtcggacgacttttcgttggggaaggcagacatgatgatgagcaaatagacgatcgatcaggcacacagctacacgcctcgagcacgagagacgcgacagagggctggggatggccgggaggggttgcgaggaggaagaagatgtcgcagaaagatccggggaaccagcagcttactgcccgaggccgctgacaccctttatactaggtcctcatcggctggaccggtcccaagaggagaaagatttacactctcacctgcctggcacatgggccgaccagccaaataacgctgcgactattactcactggctccgcaagaccgtcccagccggaatcggggcaccaatcatattggactggggcagcagatgccggggcacgagctgggaatcttgtttgccgtgggccgtggatgatccctcgctgcagacaggtttattgagtcgagtcgggagcagaacagaggcaaaagcagagatgccaagacgggtcgaggagggcgagccgctaggccaggagaggccttgctccatggaacttttttcttctttttccaatgcttattcattgctctgcgcgatgaactgatcctttgacagaatttacgttattactaagtgggataataaaattaaaaaaggaggttggcggccgggaagcatgagcggatatcttcgcagccgagatgcagtctttgcaagacagtttgttacagtatatacctaccatatatattatgataaataataaaataacccagctaaaaaaaaaataagtatccagcctaaaatagtagctcagcagacaattaatgcactactatccctaccaaatgaattacaggcaacaatcgggagaaaccttcatggacctgatttagttaatgcattagattttggtttacaggttgacgattcaacaagacttcgtgcacagcattcatttatatggtctttttttctcagtaatgaagaattttcagannnnnnnnnnnnnnnnnnnnnnnnnggtaatatattcattattggccataatcttcaacaactttataaggaagcatttaagaaacctaaatcgacaactataccaatacatcttctcttagcttggaaagcagaggagatacggattaaaaaattaaaaaatagcgatattgaaattccaaatcgaagattctttttaaaatcagcccagatcgattcacataacagacttatggtagatgaccttggaccctacttgaaaaatgataatggaaagctatcaacatcaattatatactttaaggacaagacctggagtgtatatgatgtgaaagtaaagttctgccaccactatgaagaaatcaatacgcaaggagacccttattccagttaatataaatactcctttgatataacaaacgcacgaaggaattacttctggttcaaacctgatcgagagacaatatacctagaggaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtctgtgacgacttcgatctcatcattggcccggtcgagaacggggctggctggcagcgcgatgatagaaaagtcgtcgtcaagaagctgtcggattgagaggggttgattcgacgcacagtgataaccaggtacatgaagagggcacacttttagcccccattctcagtactctagaaagtacttccgggagagccggcctgatttggttcttcccttttctttgctctcgatatcgtcatctcacgcaccagtggacagggccttgtttccgtccgtttagggtggcccatatggcacctgccagggatccgagtggttattagtcaggaatgcatgagaccctcatttatgtcacgtgtaatccgtctagtataagagaagactcactggcgagtctccgaagaaggaggctcagaggtctctagaggagaggcagaagcggaagacctcattgagctcatggaagactataacctcacaaacaccctggctccagggaccatcacgtacgaagaaggcgggaggcaggcgaccattgacctctgcctggtcagcctcgggctcgtcgatcgggttatcaggagcggagtagaccgaagtcttgaccatgactcagaccacttgccaattacaaccttccttgacgtatcggccaagcagctcaacagggagccaagcaagaactggaaagcaatcgatatgaagcaattcaagtcggcggtgttgagcaacctgccgacacagcggagaccaagaactcgaagcgctcttgaccggtatgtgaaggaggttgtcgctacactgaagaacgcaatcgagtcagcagtaccgcaaaggatatggtcgcccaaataaagaaggggctgggacgaggagtgcacgcggatgctagaagaggctaaacggctcaagcgacttcatagcctataccacacagaagaaacatgggagttatatcgaacggccagaaaccgcaaaggcaggacaatcaagaaagcgcttagaagagcacatcgggagaacgtggaaaaagcgtcggcatcgccagagtctctctggagaatggcgaagtgggccaggaacaggaacatgcaagcgccagaggtggcatccaccttgcaacatccgaacacccttcggatggtatcagagccagcagaaaaggccgaaatcttccgaaaagcattctttcctgttccgcgagaggtagaccttaacgacatcgaaagaacgacttacccggaccgaatattattgccacccatcaccgaacaggaagtggaacgagcaatacacgaagcctccccgtacaaggcccctggccctgatggcattattaaccgagtactgcaactagcagcaacatggatcacacctcacctgacagcgattttcaaccaaagtctcaatctcggatattgcccacggcacttccgggaatcgataacagtcgtgytgaggaagcaaggcaaggacaactacgccaatcctggatcataccggccaataggactattaaatactataggcaagatcatggatgccatcatcgcgacccgtctaagctacgtggctgagacacacaacctgctccctccaacccacgtgggaggccgcaagctgagatcaacagaacatgcaatacatcacatcatcgataaagtttacgaagcgtggaacaggggcagaggtcaggtagccagtcttctactgcttgatgtctcgggagccttcgataacgtctcgcacaagcggcttctccacaacctacggaagaggagaattgacgagaagacagtcaggtggatatcgagtctccttgaggaccgaaacaccaggatatcgatcgacggcttcatgacagaacgacatagcgtctccgcaggaacagtacaaggctctccactctcaccgattctctacattttctataatgcagatcttattgaaagctgcagcctggtagaagataccgcagccactgggtttatcgacgacgtggctatcctcacagggggagatacgacgacggaaacatgtagcaagcttcagcaggcactccgactggcagagcagtgggcgaaaagtcatgcatcggtcttctcgccaagtaagttccagcttatacattttactagggcacgcacgagaatagacaaggaacagcctctgcaaacaacgtggggcgaaattcccgcaaagccgacctgcaaatatctggggctcgctatggataatgcgctacgatggaagccccatgtggatgaaatacagagaaaggcaacaaagacaatatcggccctcagtagtctcggtaactcgacttggggactcactctccgagacatgaggaagatctaccgaggagtggttataccccagatcatgtatgcatgctccgcgtggtccaacggttattataatccgctgaaactgacgggatctgaaggaatttgaccggctttccgctaaattccctcttgatcgggcgtacccttgctttcgtagttgtcggtctcttgcgaagctttacgacaagctcttggccggtgtaaacggtagtcatcatcaagaccaaggcgttatccttccaagcgatttggttgacctagagagcccgggactcaattagtaaggggattactagtaaaataagtagggatagctctcacaagactatccggcgtagccacgcctcgcaaccttccctaatgccacaggttcttaccagctgtatcatctaccttagcccggataaaaggctcaaaaatgccacagttgcggcggcatatgcctgttgttccgtaacctctctctcgcagagcacggcagaggtcagcagaggtaaataggttattaatgaagacgtggaatatcccctttagcagctgatttactagggcaaccacgacactttgggtcgggttaagagctaaggttccgggccgcttcctcttgcgatctcttgcagcctgtggagccgcaacaccaacagggccgtaagctgmatctggtatatgccacagccagcggaggaaatagcctctttggcctagaacccatatcttgaagcctgttggagtcagcttattagggacagttattatctgcctagatctacctgtaaagccctgaatatactcatcaacagtaatatcagtcccaatttgatagagcaatgttgacacttcttgtatgtactgagaccactcttcaagatagctgtatagctttggaagggttaaatccgggctatttgggcagattcgaatacgcctttgcagctgcaagaaccggtctttgggcatgaatttagctattagatagaccggaagctgctaaccggcttagggagccttccagtagtcagaatatcatatctccctataaatccccatataaactagatagcccagccacagatagatctctgctgttgtcgttggcttccaattaagctgccttgaattctgctgcgataggccttccgggcctgggtcaggagcttcattcgtatacctgacccatttctcaactagcgaaatagggataaattactggataagtgacaagggctctgatggaagagggtgaactacaggctcttgaggttgcatcgcgaggggctcgaaaacgcgggctgcatcgcgtacggggtcaaatacgggtctgcaggtgttatctgcaggctgctcgcggcggctgccgctgactcttattagcaagttatcgtcgtagctgttaatagccggatactggctttgagagctcataaggaatacaccaaatgaaattgtatgtggattaggctgtaacgcgttcctttgaaccttcaagtcacttcagcaaaagtggggggtaggtggagcccgtgacatggctggcaccgcatcgcacccaaagggatgaggaggctttagattcactcatgaccatgattgccccacgtgaagtggagatacatatccacttaacaccgtgggctcagaccacagctcagagggtgagatcgcataatgtagttaggacactcacgtccttccgcattgtctaaattgacggaatttcataatacggacagggaggcatgaccttttgacatccctgccgaagccaccgactcacatgatatgcgttttgttgctgctcttccctcactttccagcaagaatccaatcgcgtgtgtttatctctcctaattttaaacccacttaacgccggtccctcttgctttttctccttttcctctctcatttcttagatcccgttaagcccatatctcatcagcctgcagattatcccatgtaacgggacttgtacgtgcgcgaggttcggttgagagattcgctcccgcaatcctccattccacccattgtcccatattttgggctaggagattcatcagccatggcaacacaacagctggattctcgacatcgcgccatcctatcctgcctccgatgccaccaattgaagagaaaggtgttttaaaatgagccgaagtgaaaatgcaatgtaaccactaaaccttgatagtgcaatcgcaagtatccctgcaaccatttcttaggccaaggaatgctttgccggtatcaagttatgagccacgatgcagccatccacattgcagctgagtaggtagtcgatcaatccaaggcaccattaacaattttcacccaaacatcttggaacaatatactgatacaaatttagaacaattaaagaggcagaagaaaacttacgagaactaactatgaaaacctggcaagtgcaggatgataggagaccatccaagtgtaggaattgttctacaaaatgccttgtaggcataaggagcccatactcgtgggtatgcgagaccgcccctgcgcaattacatgcttgtaaccaaattgttaatggtgatgacagtactcttcatttcactcgaatgaattctgttccaaagttaagactcctagctcttgcaagaatggtttggttttgtacttgctacagagttgtaagtatcatttgtcttaataaaggttcaaggtcatggttcttataagctgcaaacagttgcctcactgtttaacactcggtcaagcgcttgtagcccgccaccgccagccattgaaccccaaactcttggaagtatgatgcagaccaaatctggcatattcactaccacgtttcttagcgcgcggatgtatgcggcagagcttgagcatgccttcaatcggcctccaccaactaattgcctgccattaaagctagcagctgtgcaacagatcagagaagctgttctgacgtcggctgtattctcagacgagctcattctcggtgtgcttttcctggcattgagtcacaacaaagtaagtcctaacaattacttgcagtcaactcatgcttactcttggcccagaatatagatcctctgaacgaagatcaataccacattgatgctgctgaaaagatgatcaaggcccgcggaggtctttataagccaaagcataatcaatctatcgtaaatttgtttctatggtgtcgtcagactcaaggcaactattccttgtgtttaggcaacataccagatgtgtaatccacatttcatgctgtaatatgaacccatcaactatccaccaataaattcggagataatgagaatttaataactgctaggcattgttaatagaaacacacattctcctcctcctctcaactttgatacctaagtattgggactaagatgatgcccactgcagtggttgaaatttgggctaccccatatttttccggaaatctacgtcgttcgtccccgaccaacctcgtggatacgttcgtcatttattattatacatataacggccaagaccactgatttgagaatcaaatttcattttgccgcgaatttcgagactccgatttcctctctcacagtatatgggatttcataacattgcgtgcgatctgtggtagtgtaagcaaatctccgtgagtactgctagcggcaagacttgtatcgggccctaaagcgtcttgggtcagcccccgcgtacttccatttcctagggagacttccaatccagtaatgtatattactagaatcgagctactttgctggtctggtaattctctagccctataaagtcactagattttgtgtggtcccaattggatcagaactatattcagtacattgggtgcagttaacggcactcagggagatacaagctatgttatcttgatagcaacagaaaaaatgctcctctagattctgtggtgcgaggagagcagtcgtgaagagcagtcaacgcctggtctagtgttgttttagtcacttgctcttaaacaggcagccaaccagatgcatttgtcccatctcaagatttgaaagagtcttacttcacgagtagcacaaaactattccgaagttaccttaaataggtcgtaggctttagagagttggcctaccctgtagcttgtttaatgggacaatcatgctctgatacgctttagtatggatgttggagcttgtcaactgactgctatttgagagatactcatgtttggagcgcattatcagtaagaagtaatgtatgatcatcttcaatcgtaaaaacatgcatactgcaacggcgctcctgctgactcagaaaatgaccattgattcgaagtgctgatgggctgccatcaacacgaaagcccagcaaagccgcttccgtccttgagaaacaatgtcaatatcaccttgcgtattgtatatacagtcgacgaacacatcgtagtaaagattcctggtaataagtgcctctccacttcccatgcccagtctgctatacatacttcctcactaccgtttgcgccaggaagatgaagaggtgtatgtagagtaagcgctgtccaacagtaaagagctccacatgtaccttttactaacctccctctagcctgagcttttggtcacctaccactaatgcgactaagttactaagacccgaccacaacaattccctgggtcacactggatgtataagtttttgattgttacaacatcctcaacctcaaaatttgccccttgaaggaaatcctcatcatctagacttgctatacatgaagatacatgaagaatacatctagcgcagtcagctgatgatgtgtctttcaccatggctcaatccaatgtgggcaaaggcccttgaacccgcaggcatcacactcggagtcaagaagggtgccgcaccgctcgatataatgggaaaaagctaaactggtaaggccgtccagcttctcatttgattttttgaagactactcttgggtgatctaggccctgtagaaatcccagtcgagagctccagttatcttagttagctgggcgggactagtgcaatcagctcgtacattctctccaataacaggattggagagggataaaccataaatcagagccatgccactgagggaacttaagtaaacactgtttgctgaaggctaagttaattagcccaaatgggatctagccacggaaattgatataaatgaaagaatcatggtggtcagcgggattctaattcttgcggtcagcacgactacgcctctttcctcgaaacaaagggatgccgggctatgtctagcagtagcagggctgggagcgagtctcggttcttttctttaggactagggccacggctaggcgtggttactctagataagggattggtggtggcatatggcggctacaccctactgggaatataatatcatcttttcccacctctaaattcgcaacttaaaaccaaccaacaattatcctacagagctcaggtttctttccatacaagccagcatacacacgttacccccctgtcgacttcaactctaatcagctattcaattttctctctagcttatagtataatctagagaccaggatacattcaccttggacgaagatgctgttccatatcagtggcagcctacagcttgcagtcggcatttcaatctgcgccgccgtctactttgtggtgcggctggtgtcgcatcgtcgatttcactctaaacttgtacggatacaggatgccttccgattcctcgacacctgagttgagtgatgttgttaacatatacactagcctggtccgccccattcgccattttggggacacctaaaggtcctgggctcgtatacgcaaaggttaccgtctgctggctatttacaccatgcaataacgcagatgaaactggattttggtctccctgacatattctatctcgatctgtggccgcttggtccttgcatgctcatcctgagtagccccgatgcagcggctatccccaccactgcgagcaacttccctatgccggatgtcgtggcagagtctttcaagggcaatgtcggaaccagcttcatcgaggcgacaaatggcctattatggaaacatcttatgcaacagctgacccctgggctgaaccctactgccctcaagacgcattaccatgacatcgtcgatcacgccagagcactccatgagcgtctgcagcagtatagcgatagagcacagactgtcgatatgcagctcgagctaggaaaatatccatttcaggtcctggctacagtcttcttcggcgaaacccttagcgagcaggcatataaggacaccacacgcatggtcgacctcatgctgaccaagaacagcgccggtgctctcttcaacccactggtaaggtggaactggagaagggaaatggacaaaagtctggttaggcttgaaggcgagattgaagcgcgtatatgcgcccggtacgcagcgcttcaagagcagaaggaagaatccgctacggcaaaggcgcctacgctgcttgacaggatgcttctgccccgagtgaaggatcgattacctatagacagcaactatatgaaactcgtcttggaaaagtaagcgcgcattcggctacagtggcatataccgataatatgccgtcgaggtactaatgatagctacagtgccaaaggctttattattgctggttatggtaccaccacagacacttccaccgtatggctcttttaaccaaccccccgttaaatctcacgctaatcagctcatggtacagtatatatggatgcttcttagcgtgttcccagacgtcctcagaaagctgcgcgaggagcatgatcggatattcgacattgatttcgaccgaacgttcgaactgttgcatgaaaccccaagcctgctcaacagccttccatacaccactgcggtcaatcatgagacgctgcgtttgtttcccattgggatggtcgcacgccaggcaccccccgatctgtaaattgcccccctctgatttgcttgctatatcaaatcatgtttgttcttctatttgctaataatgctgatggcttactaggagatcacttgagcatcaggggattagatatccgctcctgaaaaatcatcttcttggcattatgagccaatcgatacactacgattccgaagtctttgaggatcccaagcgcttctggcctgaccgcttcctcaacgcagaccgacctatatcccgaaacgcctaccgtcccttcgagaggggagtacgagcctgcatcggtcaatctctggccatggacgagatgaagatctcacttgttatgatatcgcgctggctcgactttgaacttgttgaccaccaacccgccaaggagcctctcttcacccacactgacctggacacgaagctaggaaagcatgcattccaggtccacgcctttactgctatgcctgcaggctcagtaaagatgaggatcaggcatgcaggccagcgggggtaggctgtcattcaggggccgaagtactcgtcccgtaccactcaggggcgaatcacctcggatcattcgtgagccatggcgatccgacagatatctctacaaatagttattaccttagatagaaatacttgctagctcggaataatactacagtctcttacctacattctctaactcttttaactagcaattacgtgacgaccttcgtcatatgatctccttgaccaatggtagaataagcaaagacccagtaactctatctagttacactgtagcacgatagtaaccagctcgtcaaaattgagcgctccatgcgagctgtgctttaatgtgcgcgtcacgacgccacaggaaaattggcatggggcaagccacatgaatccttacagttagagcaaaacacaagtattagaaaggggagtttctgctggccgtcagccccgcataggcgcacaccaacaccacaaagtcgagaacacaaagtcgagaacaaccccataaaaggactacagtaatataccttctaaaagcagagcaaagagaagttaaacctgatatcttggcacaagtttgaatcatcagtattgcgcacactagggaggtctgttcgacctagtgcgtaccgcatctgtttcgtgcactccctttaaattaccaaggcgttagggcttatccgagaccggagattggtggagttgctctgtacaatgatgcatgcggaatggcggtgagcctgtaaaacaaacgagtcacatagtatgaatgagctcggaaaacccggccaatgaaaggcgagtcgccttggggaaacattcgcttggtggagctcatgcctaatacaatgaaatatggtcccagtaccaagccgcccttaagttcagaaatagtccctcgtaaataggatcagacgagcattgattctcagctttaaggaaggtatatatagtatttattaaaccccatcccatgtatatgatcccatttgacaaatgcttttttccagaatattggtaccttcacatagcaccatgagcctaaactcgctacaacagaaatacgctgaggaagcagccaaacgctaccgccctgaaggtcttgcacagtttctgacgctccaggaatcatcttcggacaaactacgagctttgacagacgacatctgggctgaccatgatgctctcaatgcaagagaacctcctttgacggatgatgcgacttacaagtttctcattctaggtgcaggctatggtggcctcctccaagctgtgcgccttattcaggctggcctagttgaaggtgacgatgaccttcgactagttgagtctgcgggtggtttcggcggatcttggtactggaaccgataccccggcttacactgcgatgtggaaagctattcttatatgcctcttttagaggaaactggttatatgccaaagaagagatacgcctctggcccggaactacgggaacatgcggagagaattggccatatgtggaaattaaacgacaagacccttttcagatcagaaatcagaacagcacgatggatcgcgtcaacgaaaacatgggcgattgatattgaggagaggcgtcgcttcaataatgatatcgaactgagacatattaaagtgtatgcacactacttcattattaccggaggaattcacacacgtccgcaagctcccagaattcctggccttgatttatacacagggtcactatttcatacagcgcgatggaactatgatgtaactgggggctcacccactcgtccttgtttgacaggtcttcaaggaaagcgagttggtataatcggcaccggtgcaacagcagttcaagtcgttcccgaagtggccaaatgggcgtcagcattatatgtctttcaacgaacaccctcggcaattcatgagttgggacaaacagaaacaaatcaagaagagtgggccacaaggatcgccaaccatcaggggtggcagagacagagaatgatcaacctcaaccgttttcctagtaatgggccttataacagcacctccgataagaaccttgtcaatgatagctggacgaaaatgccggctttcagtgccttgatcggtagtccggcctgggggattattgaaccgaccgaaaaatgcatcgagtaccatgtcaaaaacctgtatatgctcgatcagccacggagtgatgcagcccgtgcatacgttgataaaattgtacacgatgggtcaacggcagaaaaactcaaggtatgtatacttatgcgcgttagcaagcctcatccctctcttggaatctatgcctggcgtggtacggcattgtactaagatgtaatccttatactcgaactctcacccctaaaggttcatttactagtcttctaactgactctggctttaataacaggcttggtatccggtgtggtgcaaacgccctgcctttagtgatacttatcttcaaacctttaatcagcataatgttcatcttgtggatacggacggcaaaggtgtttcatccatagcggaggatggaatttttataaaaggtcgagaatacccacttgatgttctgattctaagtactggctatcgaaccccagtatacgcaaatggaagtccagctgccagggcaggtgttcaagtgtttggacgagatgggctggggatggatgaaaaatggctggaacaaggtgtggctacactacatggcctatatactcacggatttcctaatttgtttttcgtgggacatgcacaagcaggggcggcagctaactttgtcttgaccctcgatgtcatggcttcacatattgcatatgtcatagaagaagcgcagtctcgagtaggaaggcccgaatttggcgtggtcatagaggtagagcgggaagccgaagaaagttggacagcagaatgcatgaagcgggcagcatggtatgcgggtatgggtggctgcacgccgggactcgccacggcagaaggagaagccttggctgtgttggatgaagaagatgcaacaaagaaaagtcgtgcttctgggtggagtgaagggatggagagctatataggagttcttaatgcttggaaagtagatggtctacttaaaggcttgaagttgtccattctctcttgaagttaatagtcgcggtttgaatatacattaactatattataacactatttccacacatctctaattggttgctttcaagatggacgactagaaattggaaaaaagctgctaccgatagcatatatgcttagaagatatctatgaagaaagtaaggaatggaaaaagcaatgcatattgcattcatcgatggaacaaattttaggcttataaaaaagcataatagatgggtcattcttgagtgattaatgtagcaaatattaagcgtataaaaggggaggcaattctgtgctctcaagcctaaaacgggcttgacttcttcgggcaattttcctgctcgtactacaataagttgaagccccttattataatgtgctgtacagaagaggaaagccttggaaattccgattaattatttaatcaaaaccctgttttaaatacagtgtgacgactgtcaggttccaatggaaagctcacagcactaagtgctataatcctaaaatgaacaaggtgttgccctggctagctgttgaaacgaatctatcccgatcgaaaaaaaaacctatagtgctcttagaaccaacctagctagctattagataggcctgcctaactatcttctttcttcggaggcaattacctcaagtttctttgaggaatctgtgacgcgctgggctttaccaattacagggtagctgaatagtatctggtctttgtatgttgtactgttgattagggatatcgcatgacgaagggtcgtcgatctattaggcgctagtcaacagagttagagaatgtaggtaagagactacaatgttattaataactagcaagtatgttctatctaaggtttaatggattttatatatagctatcctgtcgtgacctgtgacagattccctaggttaatagccggtctatttgatccttcacagattagatagattgcgtgaagcctttggtcaatctgttacagaccgcctagatcattcggtcgttccttgttccgttctggcggcttactcatcttggtgtggtcaaccatggaccaccgttaaaacatatagttagttatagagaaactatttagtaagtatttaaatctatctaatattaataaggaataagataactcttatatctctatttataattaagaatagataaataaaaaattagaagatttatctaatatagaaatagaatctaaagaatagtttaaaactctaaataaaaagaaactagataaattctactaaaataaggaatacctagtagaatagagctctaaagattaaattaaataataaatagtagatatatctatagaagaaatctaagatataatagataaactactataataagaatataagtttagataaaataaattaatagaataataataagaatttaaagaagaataagaaaagaattacctatttatttaaaaatattaagtaaaaaatagttaatattatctataagtaagatatagaataaccctttaaaataaaaacccttaagaaatattaaaatagttatatatatatagatatttctagaaataataattaatagaatactaatataagtactagtagatagtagaactatttataactatatagactagataatagtggactaacgaaaaataaatagcattatattcaacgtgagagtacctagttgagtgttgatgactgacttgcggataaccagctactcatctacgttggaaacagcacctctaaatcaaggattcgactttattaagaagttgccactttccccgcgagatgaataggcattcgctacttgtcaagataagaaagagaacaagggcagacattgatcctcactatcaagtgggccgccggacgtgccacccggactgaacggaggggtatcctacaacagcaaagagttccgatgtctttgtcgtcttatatcatgccaatctcagatatggttcaacactccctgtataacacgtatgccaatcatgtcaccggggacgagttgggtaaggattgcctgtcagcatccccgtcatgcaagcttacacaagcatggccaaaagtcattattcgtcactatctgctgccctgccacctctccctttctgctctagctttctcgttggctcgttatcatatccttgtcattgtgacgcctgaagcagaacagacgtggcagtctttcacgccgtcgttccaccaagcaccaacttgacgcgcctccacgcctccttcttgagggcagcatactcgtccgtcgtccgtagcagcgtgtcccggttgtcgacggcccgccgcacgaggtaggtcaggcactcgctcatgcagccacctgtcgagcacttgaacacccctggcgcttgactcccaccaaccccctgatggctcatcgtcgtgcccgccgtctcctataggagggagaagctcacctcgcccgatatgccgtggagctgcccaaaggagacgttgaccgtccggcctgtccgcgtgcgtcggtgcctggtgtagcctcaatgcgcccagcagactcgtgcggttgtggctggcgaggaacagctcggccgacgggaacggccgcccatccgcgccctcgccgtcgccgccgaagctgctgagatgctgctgcaaggcaccatgagcaatagcgttgtaagcgtcgtcggtgccctgcttggtgtcgtggatgagggcgtggttgcccgagaggatgtaggcgcccttgacgagcttgacgccgagtcacagcggtaccagcgggccattttcagcgtcccgatccgccaggcatcaatgtcggcatcgatcctggctccctaggcgtctatagcttcctcccctccttcatcttgccatgctcgtgtgccctctgtgactcgtggtcaaagacggtttccatggcatacatgaggatgacacctcgggagcccaggcccttgagacggctgatgcacgccttggtctgctgggccgtctccccatcgcggaactgttcgtaaaagcccgagctcaactcatacagccgaaagacatgactcactccacgttggattcgcgccaacatccgatcctgagaagaatactcccggccttgctcccgagatggaagctgaatcgttgccaattccacaatccagcgcccacagcggcgccactcgggacacaagcatccaaactcctctggcagagaaaactagcacagatggatcgcacgagtcgacgctacgtccccgtcccgcatcatcgaccggcgagactgttctccagaatgaaagtagcaggtcctttgccatcggttctttcctgccgcaggaaaaaggtcttgagtcgaagcacctatataaagaaggaagccctatactatcttagactaatattaagtgtggcctgggagggacaggctctgaccctgccgacggcacctcgctcgccgttgccggatggtatgttgttttcctcctacatctcgttcaaagctagaatactgacaactcgcgaaaaggggaaatgcagacagatacagagtgtcaaacaactagtaggcgcaaagactacatgagtcaccttcagaaacagtcgcagcaagcctgccaactaatttctggaccgagtggaatgttcggctccaacctttcaattgccgtagactccgcgacgcgatgtctgtaggctcatcaactttggtgacctcggttgtctgtgcgcggcctgcatgagtattcaagcaggataccagcatgtagcacttctgagtcatgaagttctcaatagttcccaagttcttaatttttccgagcaaaagctcgacgaggcggtatcctgctccggcactgtagcaagaagtgcatggccggccagttgaacttcgtagattagttaatcatattattctgcgttttaataaccatagggacgtggaggtgataagaatgccccatggtggctcaatgtggaacgtgcaggaggtagtccttcactgggcgtcaatgaaccatgcgcacgcagttaaccctctaaaaccaatatcttacgtgcaaatggtcttagtctaatgacttaaagcatgtaacgctacgatggctgataagaagaggactaaaacctaagctaaagcaagggacgtcgagctgtttctagtccctgaacattcagaatatattctattgtctatctgagctatgtattgtttaagtatgccccgtatatcaaccacgcaaatttatgagttatactcaatgttaaaaacttgtgactccgccacctcccaatcattgcgcttctgtctttctccaaagatttttaaggctcggtatacaattttatatgtgcctgggggggtataagttccgtctgatagtccgccactccatggaactgtttcaacctgccttaactgccagagtttcggaaatcccgaaacctgtccgatactaccattgcggggcacacccaatgctgtcgagtcgaggcgttggattgccacggggacaacttctgcatgtaactcaggtgagcctagggttagattatgcatcaggtgcggaagagttgcacccagggcagcagcctcatcttgcccgtatactttaccaggctttggcaagacaaaagtagtgttttctggaacgatggtattttgcttgctatctgtgtggaagatcgttccgctatgctgaccaaggactgtcgatccgtgcaaggaaccgctgagtccgaggtaaggaagagatagtacagtagcattgtttacagtaagcaggatatatcccgaccatacaggcaatttctctgttgggaggtcctcgggaggggtcggaaggacctcgattgtcacattctctcccgaaaggaccctaacagtactctcgctaaagtccagagacgaatgtttggtggtaaattcattggggaaaccaccatccaaagtcttgacttttggagtatacactgttaatgcaggcacgtgtgtaatatcaagctgaatgtcttcagagccagtatttgctattgtgaagttaagagccccaagaaaatgatcggtgtcgttgaaggacagacttgaagggctcagaacaacttgagcatgcgccgcgtcgtacgcttgaataatgccagcaccctgctgtgggacaggagcgagaatatcatgataagaagtcccgttgtggaatagctgaggtttcgaggtggatgagagaatattttcaagaaccgacggctcaagcgtgccgcgaacctcagaaatcaaggcgaatataccagcagccaacgggcaagccatggaggtgcccctaaaaatagcatatccccccatgcttaagggataggttgacaatatgctgctgccaggtgctccgaattgaggtttggagatcatgtcccagttcggaccccatgaggagaaagcactcacagccccgcccgtgactgtgtttggcgatttgttgagaatcatgttgttgtctgatgtctgccccatgtcaatggtcaccttcgaaccaatcttaagcaggttcatccattctttaccagtgtcacgcgtagttatagcgagggccttgataccatcaacttctggcacattaatggtcgtcaatccaagatcaagactgtacatcataatgtactcggcaccagctgcagcggcaaatccagctttttccttggcgagacacctcccgctattgagcagaactatatggccgctcaaatcggttgcattatggtatggctcgcagccaaagttgtcattgaagtcatggctcggcgccacaagcggaagtttgacaccattccaaccatctggagcagcgtgtgaagagccgaactggtagttcccgctctcattgacgctataagatgatatgttgaccagtgagaatgcttcaatgttatcaaaggaggcaatggctgtaacgcccttcccatcggctgggccacctgggaaaaagatgccttctgaaccagagttacccacagcaactaagcatggaactccctgatcaacaatgcgagaaatagcaagagcaggggcactctcagcccatcctcgaggaccacctaaggaagcggtgatgatgtcggcaccatcctcataagcttggttaaaggcagcaattactgcatcgtccgaggtgccgccgtggcaaccaaaaacccggtaggcgcctagctcaaccccaggagccgcaccagtgaagtggaatgggttttcttgagcggaaatgatacctgcaacgtgagtaccatgaccttggcagtccataggatcatcgtcatagatgaattcgttttcaccgttgaaatcatcgcccactaaatctgcgccaaatgagactaagcagtttggaccaaaacatcctccgagagcaggatgcttatagtcaatctggggaaaatgccattaatcagcttttgcttgagaggaaatagtgtcagaaatcttcacttacaccactgtcaactacagcaatcttgatgccatgaccagtatacccttcttgtcgcaacttgtcaacttgggtcataacatgaggtgcaaaatcatcgctctgcgcatggcgcttttcgttggaaagaatataatcctgacccggcgtgccctgccactcaacatgtggcttggcattcttatgaaccctgacaggccacattctcttcaccacgggaagcttagcgatgctttctgccactcttccggaattttccaggtcggtaaactgaactgaaacaccttggaataacgtatagttgagctctgctcttgttttcccgttggcagcaatttgggaatcgaagtctgaccggtcctctcaaaacgttagcagggtcatagaagcaaatgcccaaaaacagcaactcaatcgatataatcaaagagcggaaagaaaatattaaatacatacatggttattgaactcaaatatataggcacctgcaagatgcctctcatctgaactgtccacttcatgaccaatggcttgagatagtattatggaaagtaggacaacgacactgaggcggaccatctttgtggtctgcaacttgtttcctgcaacagttcaagcagcagaagttgcaacagcaaaagagacaaaaggaggaattacgaaaaagagatcgcagaagaaacttcaagacagatagtgaagaaaatatgataagaaagaaaacacaaaacagacttgttgtcatgaattgcaaaactgtaggtctcagcactgtttatattctcgttgatatccggtgaaatttcccctttgcaaaatttagcatcgaaaatcaaggcattgtcagcgactccgtttcctccgtcaatccgtctcacgaatgagaaagcccagaggttgcactgccattagatgacagggtcggggttaccaacaaagacgacaagaacagcaggagacggaaataggatacgagatgtgctattacgtgaatgcgcaattatcgtgtgtaggcgtcgggctaactctacgggtgtttgcattgctgactattcaaggattttaagtggtcaacattttacgaggtgagtttgaagtggggatttctgatttgggtaagtcagcgcttacctcccaaggtcgaggaaccacaacgacggagtcccagctaagggccctttgctgaatttacaatgcatagaccgtgttctagacacccagcatccccggtgctagatgaagattagacccattcatttggcgatggtaagagaaatttcaggtgaggtcatgaggctgttgcggcatgagtacggtttaagaatctaaataacttgttaaaaacatgaactaaggaaattcccgcaaccaatggccgcagtcagcaatgctaatacgtacggacgaactgaacgaccctaggacttaccatccgcctaagatttcggacatactagccttgctagaagagaacgatacgatctacatgtcaagcacttcccgagtagtggcccaaaacggtcaaatgcgacgagctcggtagtcactggatgaaattgtgggatttgaagatggccttggttgtgcgaacggcccataggcggcagtggaaatggtaagaatttagttgggtggagatgcggtgaagatcagcgggcaagctcggcatctgctcgaaatccgagatacgctggatcatgattggttctaaattacgaatgctagagagcctcgaaaaatgcttacgattgtccgagagcatacggattgtccgaggactagaatgaattggctgatatactagattatatatacaactagacaactagtagttattagtcggccttatccgattttaccccggttatcccaacaaagtaaagaaactagataagatgtcagggtccaagacagaaggagagaatccattcacctgagtaccagcttcttcctatccacaaatacgcttggcagttggctggtcgtaggcctgaaccctactgttatcttattttcatgtgggcacatcagggttttgctattcgcgctattaggtccatcgtgcatgaatcgacatgaagtagagaattatttaaaagttgggaactgccaacttctgattagatgactgtggaaaaatgtataggaaccaaactaactgcctgtactggtggagataccggcgccggtaataagcacaatattctttttagtctggagcttcccctgcagcaatttaaaagtttcctagcccggctcggtgaggagctcgtatagttcaaccagagatgaaagagccagctgtattctcactaatccctttataatggcgagattaaacgctactgtagacaaagccagctgacggcgtttattaccctgcccgttaggttgatacgatcaactattagcatgatgaaaatagtaatgactggatgtgtccacaattgattgagctgagagcgtgtcataagaatcccataccacgataagcgagattaagagaatatactccgttggacaggcctagccttatagggtactcgtgcccgccccacctttttggcaggctcgtaaactcaccgcccttaggcggtgctgaccaccgaatccggccgngcaataagaaaatgtggctactgcgctcaagaccatgggtcccgtgagtgtcccgtgaagactgacaggagcgtacctcaaaagtgtgccaactgccaaggtcagcatgaggcatggaacaaccagtgtgcaaacaggaaggaggagattgccaaagttaaggctgcatatgctgctcgccccaggtaccacctagtgcctcaaaacaacgtggtcgctaaccaggcaaacccaatggtgagagtccatgaggaaccaagcggacgagcgatacgagagggagcaccatctctcctacccggccgcacacaacagagtcggcaaggaaggagtaggtcaccaacgaagaggggacaaaagagggtcaaccccgacaacaatgcagtccactctaacggagtagaaaacgagataacagtcaacaggggcagccaacggccccaaagaattataacgccatccagaagggccttggaagccctcgacgcaaactcagcacgactacacggcgcctttcaagcggacaacatggatgtcgacaaccgtgaatgagcnnnnnnnnnnnnnnnnnnnnnnnnnnnnnnnnnnnnnnnnnnnnnnnnnnnnnnnnnnnnnnnnnnnnnnnngggcaaaccccttcatggacactacacaccatccggcgaaagaccgatttcacctgtgttacccccagagcaacgaaaagggtgcagctcaggtctgcctgttcatcaacaaacgattggatcattccaaatgcgatttgagtcacacagccggtatctctgcacggtaaccctagtcctgggacagggcgatgagactagagagatcaaaataatatcgcgtctggcaggtgttcccttaacgcgggcgctaagcgtgctgtgaggtaccatgtagatttttgcagctgctcggatgctgagctttggggttttctgtatagcttggcaagctaagatcatctgtctttctttatctgcagtttccattattattggtagagaaatgtgcagttgaaaacagatggttccatttccgaggtggggtgtccagctcgctatgctgtccagctcgctatgcacccacgttaaatataaaattgatcattactatagatttggcttatctgatcttttatcctgtggagaagggggccaataaaagagtgtactggaaggatgcttgataaccacttgataagagatactatctggtcatttaattcgatagcatcaacgatattatcaatcttatattcagtctctgatggacaacaggtaaaaaagaagccttctatccctaagatatttttagtataatgaatattatcgaaaggaattgaacatacctctaacatcaatagtttggcctagcggttgggcagctttagtataagaaagctgagtacatatatttaacttaggttcgaaactaaaatttatgaggtagtatgtacgtaggcaaacctaatttatatacatgttgtagcactgcgagcagttaacctacgtagctagacaggagacgattttggccctgtgcaaaactcagcagagtaaattaactccttgactagatttaccccatagaactaggcgacacttcattcgtgaatattagactgaagcaggttcagtatataatcctacctatagtagttgatggattctatagttatgaagacaaacctctggagactttctcttatgaaatacatacatagcagggagttgacattcttatatagttttgaccctaaaactgggagtagctataccaagtatccggcggctgaccgaagaaaagggttggaatttttacctgctcttaaatcttaaatcaagctttacagttgaacccggcaacttgtcgaactccctacaagaaggtcgctaagagccaaaaagttggtgttatataccaataactgggatttcagattaatcagcttcctcaatataaggtttattcccctcccccgaaagatattaattatactacagatattacggtctacacagtacctactacccttcagccgtttgaagctatggacaacgaacagaaaaaaacacttggatggccggatctaataccacaaaacggcatcaaatattttcagaataaactcaaaggtggaaacgccttgattataggaaaagatctccggggagatcctgatcaaagaagccttatattcacgtggtttccgggacatgaacttaaactcaaccctgaatgtgtttataatagtgaattcagccctgaatttcctaatgaatggacgcgggaaaggaatttacagttagccgacatatcccctaatatcaaactacgtctcagcccgatagtcgatggatctcatcggatttttgttgatagactgagcgacttcgtgcaaatgacggaagatggaaagctagaaacacatatccttctcctcaacagtgttcggccagtggcgatcaatgttatcccgagatcatatcgacccaaggaacttgagtcaacagtgtcggagctatttcactattggctagacatcccagaaatcccagaggttcggaagtcaatcgttttagaagagtgggactatacaaaagaaagcggggtaccctggcacctacgaaagcctcatgggttctcacaacaagaacctctcacctaagcagcgaacctggcgtcctgtgtagttcggttgcgaaagatctgagtaatggaagggcgtaaaaatcaattatagtgcgatagcatggctgctctttcaaacaaaaaaaaacaaaaaaagaaaggaaaaacttccctaggaatcgttttgcagataatccttgtttcaaactctgctcccatatatctatgatcgctagatgcatggcctaaaagagcttgatttcgggtatatttcaaacatacacattatagatagtctagcaataaaggtaagaacctatcttaaaattgtgagcactgaacacgtagggcaacaggggacagccgattagtgaaataggtatgattagatttgcgaattgcacgctggtgatactcacagctagattctagggatacgatggttgtggtctagacttacaaaattaacaaataatcttaaatctcttagaatgactatctaagtgataccgctctattgtcggacggtagtaggcgaggtatcagaccagatgaataataaatcgtggaatatatttagttcatatagccttgtgctcttagcctctattctagaaacatttcttcacgacggtgcttggcatataacttcgtacaacttaagctatgattccctgcaaagttgactgctcatagggcttcgaaactgagcgtgaaatgttgatgatgctctcaagctcgcagttaggtattcttccccaaccacactctgtgctaactccaaactgaatccctccaaagtttcgcaagaaacttgaaccatatcccgtgttatatcaatcttgcctgcatggacaagtccaaagaagagttccgtcttattttcgcgcaatatagggagcagtgatttgataggcttgaagtacctctcaagttttccctgtgcactcagagggactggacagtgcatataggtggcaggtcttttgagtcttttgaaaatttcgcctgccagttgaacaacgcccacgagggtatccggttcgattgtgtgtttataggcaatatcacctagtaaaatcagtatatatcttccgaggccaaactagaaccatagcaaggcaaaagtgaaagccaagttcgaccccgggcttgacctcgttaaccattcgagaaatataatcagccaagtagccctttccgtggtctgcccaccagggcttctcccatccatcgacccagtacagcatatccacgcccatatccaatcagatcgcgagttcactatttggagctgtctgttggatcttgtgcagagatctgaaaacagcctcttcgtaatgtctttctgctttttcttgaaatggtcgtgctataaagctacccacaacattaccgagggtaggcattgatacctagaacttagccccacgaggaatatccccattgtctttccagattttgaacacatgataacttttaatggcagcgtcatcgcaccctgtatgtattccttgtttagccttcatattaagaaggcgcatcccttcgtcaatcacttcctctgtgatacattttggcttaggtggccgtgggacaaaaatgtccagctcagtctgtataagtacattgaacagatccttctgaaagcacacaaactgtatgcggtcaccagtctcgccatctgggtatcgtttaagatgctgtcggaggccaaagtatgacattgtagaccctctatttgggactgtagatctttgtttgtctgcaagagttgctcattttgcgaggatttgttgtctgcaagtgccttccattgtaaaacccggacatgttgatgttgtagaaacgacagacaaacagtcgttgtattaccacagtactcagtcattttttacaatccaaacaacatgatgcaccctcacgaagactaagcctcttaaatgtatattcttgtaagcaggaatcgtatatgagcataccgtaggctaaaaatggctgcgactgggacgttggttcatttacatcaacttcgggtctaaattatccattatgtgtaacgaatgattgtgacggttgagcggcttgaactggatcagggtctagggtaagctagggatatgtggcagccagttgtcctggtggggacgatcaagttgtcttatttcagtgcgagttacggctggcgactaccgaggagctagctctaatgaagcggcagcaatgttactgataagtgtctagaaagagagtgtaggccatggaaatgaatgtcaacttggcacccaaagttttaactgcttcctgcatagggacatagttccatattgctccggtgaattccaggaggcagatgcgacagtagatccagcatgctcggatcaagattgctacgctcggaggcaaaccgctcaaaggtacctacaacagccattcaacgcacagaaatgtacagcacagggactgaggtgactaccgtgcattacgctaaggctgcctagtaagatagggggggaccgaccccctgataaccgacccccagtcgacccccggttgaatcttgaaaagaccattggcctacttacggtattcatatgtatatctcaactcttgcataaatagttatgaactgagggtttgaactagccggaatgtataattcctacccggagtccactgggggtcgggtatcagggggtcggtctcctccccctaagttagatgtacgtacgtatctagagagtgtgtatcccggcgaagtcctactcgctacatccaccccttctcctttcacccacacaggtgtctcttgccaggatagcatgaatgcgcaaaggccttcacctccataaaaatgtgacgcgcggcggacatagtggcccgggctgtactttccctaaaactccatacctagtcgggcttagcagtctcccttaatcttactcaaagagaccaagttgcgtctaacggctcaaggagctccaccgtaagcgtaagcattcgatataaaataacagcaaagaacatcatggtgtccaacagcccgtccgccgaaccctcaataacagactggaaatcctccccacgactataatcgagcctgaacatttcgctttatcgcctaatggaattcagttattttccaaggcttccggctgaattacgattggagatattacggcacgttatcccgccgccggctgctagagtttttgccttctgtgtcgacaaggaaaatgtagcagaggttgaaggagttgatccatctaagtatccgcggatacttcaacctatctgctttctctcggattttcacaaaatcgaccaattttccgacaaaatcttcgaagaggagcccggcaaatttataaagatcaagactgcaactttgcttctcaatcacgaatacaagtcttttacgaccagccacatcctacgctaccctctcaaccctgaggtggacgtgctttgcgttgacaatctgattgactgttctatcgactgggctaggatttatgaaaggaatagcaagttgatggatgctatcacctgcattatcaaattgacccattggatagagtggaatactgccgaaatcattatattcagtcttcaactacgccatgtgaaagtcatttcgcaagtccagtccgacgacatagacaaaatggacgaaaccaacgaaacagtgttccgatacgaacgagacgaaattagaagtaggtggaacgaaattatgagaagggggaaaaaacggtcaatttataatccgcctggtatgagagaccttagtaaaaagagggtgcaagaaattttgcgcaatgttcagcgtcgttttacatactgtaatgagtatggagagatattgggtgacctagagagcatttatcaatatgtacttatattcgactaaatatatcctctttgaactgtaaactgtctgttatcccatatcagccactgtttagtagacgcaattcgacagccaagccagaggagtttcccttcgttgaccatccattgaggccagctcaatttgctcctccagcttgcagttctcaaaccacgtcgacggaaaatacttatccgcaaataccaagcttcttaaagcaaaatcctccggcagcggacgaggggtatcattcttgagagctcctgggaactcctcgctatccatccttgcttcaaacccacaagagtcaagaatactatcaagcatatcggcagtagtctcccatggaaatttcctctccaaatggacgatggcagctggcaatttgctcaggcgccatacaaagactaaaaaggtatggaggaaggacaaagtgttagggtctccgaccctgctcgcgacaagctggtagacgtctattgcaaagtctcgtgcctttgggaatagctcattcggagaactagtactcatgctggcactatcgctaatatcctgcttttgacgcggggcaatctgattgatgaaaaagttggactcctctccataatctaatagagagcagcataatgctattgcagtttggtagctagaagagaaataattagtcgatgcacattctcatagtattcattttactcaccctattgtacgccacttctttgtgactgtactaatataagggtctaaaagtgtaaggtaatctttggaggcttggtaaaagaggtcctcagctttcttggagaacagaatgcgatggacacaaacaaatgcggcatcaatccaagaaaggcggcgctcacaagggcctgggtaaaatagagtccagatgttcttcctggtttctgtgaacggcaaagcaacacagagagatttcgcgtacagatatagcttctgaacagcatcgccgcgggccaagattgtaagatgatagtaaaggtgaccagctgatggtgatttttcggaagcaaggctataccactgtcgagaaactcctatccagatattgccatcatctgaattctcgtcgacaaacatcccgtatctggaaacatctcctaggaaattaagccaaatatcctcaagaataggaacagactcatagagtagttctagcaaggtatatgcttgatggataaaggtaagcatgtgctcatgagaaccaggctgcctggtacgaagtatttccaagaaggagtggattccatgcttccacaaacgtccagccataagatacttggctgggaggcgtcgaactgtggtgttggctattggatgatatgtgagcgttgaaaattcgtagtatttctccaagagctcgagttggcgcgcagtatatactttccattcactgtgagtcacttccacgttcagatttctacaggtttcatgagtttctatgcactgtgtctcaggggcatatagacgtctgtagatatgtaccacgttttccgctaattccttactttttctctcggcagttttgagcccatatttcagatggctgttaagcatattctgactttggtctagccaacaagtatgaccgtccacctggcgctgagattcgagagcaccgtatagcgcgtatagtctgaatttaagtggaaaggatagatttatatggtattcaagagagccagatgttgagaaaagaaagtagtagtgtacttccggagaaaagagcgattgatgaccaagtgcacagaggctatttgttttacttacaaactgctgtgactgcataggatggcgcttgcgagaccgtctactactcgcctacatttatcaaatgaattctagtgcacgtgctcgggcctctatccgactcagtatacctgctgtatggtggcttcttgtacgcaagggggtgacaagccatggatgcttaggatctttttggcctccccttcgcatggccaattagatgaagaaaatctgatgactgtggtcatttattttcagatctgataggctagagctgcgcacaaggaattttttttgccggtgatttttataaccgacaacctgcgtgacgtttctcaaaggctctgtaggcctgatggcgagccctatgcccgagtggctgaggtggctgagtgccataaatacgaggtttcccctcatccgggttgatcgctgctgacacaattactgcacctcgtcatggagaccgccggcctagtcatcggagttgtcgggctcgtcggacttttcaactcttgcctagaggccctcgataaactgcaagctcaccgggccttcggaaatgaccctgacgtcctagatacgcgatccaatgccaccaaagctcgcttcgagcgatgaggtccaggcgtgggcatcaagcggggccaactgatgcatgcccatcgcccagctttggacgacaaagtcctttcagatgcagtagccaagttgttacatgtcattgtcgaggcgatttgcaatcccggaaatgtagcctcccattgtgttcggggcgttggctttgacaacgacggctcactagagggacctgcacacgcttcgtaatgtcacgcatgagtcgagaaaaaagaaaatgacattgaattctttgttatggaagaagacttcgcggatgctgagagagtgaccgaagttgcccagttctccattgcggacctcggtggtcccccacctaggactacgatcgcccaacaaccagcacaaaccccgagggcgcagacaaaccagctttacagacgaacaccaccctgatgtagaggccaaaaaaaaacaggaatagacggatgcaagagctttttcaccctcggctataccttacctagacagatcatggtgccgtgatcataacgtcccgctcatcagtgagaatgcaacagataattaaggtgggcaagctaagcccacgacagtctggagaccttgccgtgcacgtctggcttcaatgatactattatgggcagaaagtttgcgaacacctcacagtgccccaccttaaacaaggaaattctatattctattaactaactttttttaatattatggggttagcctgtggttcctgtggcttttccagagggctttgttcctatagaggcaaaaccgcggctacccactgctcgtccccaccctcctcattcaccgccctctctggtattgaacgtgtctaggtgaaatattggttatagggtatatccgatcagcaccacgaatatctcttgggagcctatgattggggtcgatcaaaaatgcaaattatccatagccagcttcgttcctcaaggctcctttgcgcaaaccggtcgcggtttgcctctcctgtatgtctatcaccattccactctttatttattagagtacttttattatcctaccactatatccccatttcaatccaatttattatagatgcgtcgtcatccatccagccagctcagagcttgtcctgattgtctcctgactgaggagatccagcctagcctccgcagccgccatattagcagggattctattaccgactaggtccctctctcgagcttttgacacgagtatgatcccgtctagcaatggacagcgcgacagctgcacgtatagactgtatgggtcacattggctgggcaccacgttgccatcgatgtttgtcgtcctagtcccgcgcagctccaacgccacctggttcagtgtcctcccttgcaccttgtagtcggtgcatgcaaatgctggtgtacacggtgaacccttccgggtgacgtcgtgctgctgccacggccgtttccgctgacattctatcctgatgctcatcggcgtcagcaggatcgtcccaggcggcatgccgacaaagtggaactctgccgtcgtctcagaggctaaaatgatccccgccggtggcccgaagtggagtatggtatcggctgagacctggtatcctggaaaggccttgtcgatgacgacttccaaagccgtgtagctggccccgttgacgagcttgaggccctggtgcgtgttctggttgacgacgacgggcatgcccgggacgaacatgaagatggccggcaccgggatcgcgctgtcgtcgccatggttgagcatcatgagggcctcctcctctgtcggctgaccgtccttccacttgtgatcggatatgaagatgcgcagtgttgcttggtgttgcatttggaacgccagaacggcttccgtgttgaggttccagcggttcctgttcagtggcgtgacgacagtgatgcccgattcccatgggatccgcctgccttcttggtagcaccggtcattgaggagatcgacatccgactggtcttggatcccgcgccggactcgcgttagcagagctcgcagttcagggtcaccggcggcacggacctgttcgtccaacatgatgacggaagtaaatctcctccacagggcgtgagccttgtcatgttggtgtctctgctctacctggaacgaatcctgttcgaaccacgagatggccgtactggggagcaggatggacctctcttgtacggggcggaactggtggaagtcgccgcagaagagaactatgggtatgcctccaaagtccttcggagacccccggagcttacacagctgctcgttcaccatccagagagtacgtgccccgagcatgctgacctcgtcgataatcaggagctccctctcccgccagtccgtccgcgaagggccgtccacgtatcgatcagcgggcgtgcagggtccgataccatcactaccagcgcctctgcccccggccatacgtgatgtatctttggagaagttgcaggccgagtggatcgtgattccgttgatgcgcgctgctgcagttcccgaggttgccgtcaccaacaggcgattcgagatcctcttgcttgtgaaaagctccacaagagcctcaatgatccgtgatttcccggtgccgccctcgccgccgacgaactggcacagctgagggacaggttcactatccgcgtcctcgctccggtgcaccaggtcgagctggcggcagatcaataaaagggcgattgattgctttctgttgagagtgaaatgctctgccagctgtctccccgccgccaggaaggatgtcgacggtccaaggcggatgcctaccgtagggccagcaccagcaccngagacgaattgcccacgcggccgacgtcctccggcagcttcacgaggataccccgccggggcgggacacatcagtatccgccgaacaaggcgcccaaagacctgctgttctgaaccagagtcgccagtttctgatgagggtggcgaatcgtattttttccgagagacagctctcagccgttgaggtatgttaccacatgctcagctatcacacggacttcaccaacatcccgcactggtccttcttaaacctgaccgcattgtactgggccatcttccgcagatggaagcatctccggagccaggccggcgtagagacggaggccgaggagcccccagagtcggtacagctcagggaaggtgggcggaccctgttgtgcctcgatgcttacgcctgcaggggccgggtcctgacagatatatgcctctacgattacatgtctatggtcagcctggtccgtagccgtggccgggatgaggatgagaaccacatatctctcgcacctctcgacgggccctctgtggcttgccatggctggttgcagaagctccgccgacctcatgagtacgccgtgccgatttttcaaggatttatcagcgacgatcnnnnnnnnnnnnnnnnnnnnnnnnnnnnnnnnnnnnnnnnnnnnnnnnnngctggttgcagaagctccgccgacctcatgagtacgccgtgccgatttttcaaggatttatcagcgacgatcaccatgatgagcacccagtgtacttcagacggtatgccccgagcttgcactgctaaccccgaggcttgttctcacatttccgtccagtaactctgttctccatctggccctcttcgtgccctgggagcgctttctttccgatattcacggcgacgttaccgatttgtggctcagatacgaggcttccctctgtcgacggctacgctttcacgtctccaacatctccctcctcagcaagtcggcggaggacgcacgcagggacgcaaagctatgggcaagccgatcagaaggcgacgatacagtcgatgtagaactccctcttgatgaggacgacgataatgacgtgcgtgcaacagcggctgagcatcatcagaattttgcggccgtgctccacactctgcacaatgcagtgcgagattccgacgccacgaggggctccccggtcttgataaattttatccgcgacctgcaagaagaaacttcggctttggagcgtaggccctttgtccagcatcccgatggcttctatcagcaaatccgtcgcagccaggacgctcccttataccgatgccaggccttttccgtagaggatgttcaggccgctgcgaaggcccaggagatgctccacctccggatactggatgagatcgagacgggtccacagggtggcgcacaacccacacccaatgccgacatagatgatgtgcttgcccgtaactacgatatggagatgcccctgatgcttcggagtcgagacaccgttgcacaagatgctcgaatgcttgttgaaattgacagggcaactggctttgcagaattaggacggctttccgcgtcgaacctcaccctcaacactctacagacaatggcccttcaacttgtgtgcaggttcttggacagatactctgcggaccccgactcagcgggtcaacacctccagtacaccggaggccccggcggcacaggcaaatctagggttattgaggccctgaaatgggtcttttcagcgaggggccaaccacatcttctccgggtcacaggaacctcgggaagcgcagcggcacagatcggtggcacgacgttgcattcggcctgcgggttggacacccggcgctcccccgacaagcacctccctctcttctccgaggcgaagaagtggacgtggaagcagaagctagtcctcgtaatcgatgaagttagcatgcttggaggcgctaccctgcatgaggccagctgccgcctccagtcgctccgggactgcccggataagccttttggcggaattccagtagttcttttgatgggtgacttttatcaattcgccccggtacgggagacgagccttttgctagacagaatgggaattcctgctaccatgtctatggcgcaagccaccactcctcattatcgcggtttcagcctatggctaatgttcaagaccgtcgttcttctcgaagaacaggtccgcgctcgagacgaccctaagctgggcgatcttctggacagggtacggcatggtgctcagacctggcaagaccttgacctgctgaatacaaggctggtcaaccgctcacatatcaccttcagtaacggcttgcgcgccataacacccctgaatcgtaatcgatggagcctcaatatggaagccgttgtggaatgggcgcgcttcaataagaggcatatctccgtcttcgtgtcgacacatacctggagaagtgccggtctgtctcaaaatgagatagcccaggcggttgagcaaggggatgactccaagtgcaaggtcccaggcatcttcttctatgctcagggaatgcccgtagttgtcaataagaacatctatactggcttaaaggttgtaaatggtgcagagtttactgcggcagatattgtccccgatccgagatacccaggatactatcttgcggacgacgtcaccatacactttggcccaccgctaggcatcctattgcaatcgaaagaaacggctggtctggcggtcccggtgctcccagcagagctggtgctcatccgccccgtctcgcacactctcgatccaagcgactctcacttcaagttcttgtcagcgaagtgtacccgacgaggactaccagttgtccctgcatttgttcttaccgactataaatcccaatccaaaacgtttgccgaagtgctcttggagctgcgggggagtcgcatggtcagtggcgaaccttccaagtgcgattttaccagcctctacgtgcagttgtctagatgtacgacacttcgaggtattaagcttctcagccctgtacgggcccaggatttcattggtaataagctggatcaggctatggtaaatgcgatgcagagacttaagagcctggccgcggagacgaaacgtctctatgagggttagaattgtgatatgtaggcctcgccatcctatttgaaccttgcgaacccgtgatcaagtataacttctccatgaccagtatgtgtcctccctagtttctccgtatattcaagatataaatcacaatattgccaatggctcttgaagtcgacgcgaatcacgatgacatggaaaggttataagttggggaattcttatttctcccttgtttcctggtccgtgcgctagatccagagcctggattgaacttcaaaacacaagatggtccgtgccttcaccatccacaatggcgatgtttgttctcgcaatacctcgacaacccacgtgaaggactcgttccttcaggcagtggcgggcccgctaggggccggtctcctgtgtgccttgaggaacgaaaggctcttccttccgccccctcgaaagcaacacctgggacaccgccacctgcgccacaaacctgtgccacttcaagccacatctctagagccacagtccggaaagtctcgttccgaaaggtctgctggcgggccccgtagggggccggtctcctgtgcttgactcccccgaaagcaaaacctgggacaacgccacctgcgccacaaaactgcgccacttcaagccacatctcaatagccacagcttagacttgggggccaaaatctcggagccgaagtcttgaatcactcaaccacctcattacctaagttttgtattttgctcgctcatttctaacgggacacaagccggtcgtgagtatatttaacctttgctaagttttgtattttccagcgaactttattgtggacactgataccaagttttaggtctcgagtccaaactgttgcaccagacggtggctcctatcatagcctatagcgtgaaacagtcttacggtttttggctcctgcttatgacacaacacgatgccacgctctcccaagtatgtactgatattttggtaaacctcttcgccctcgtgcttgaaagccttcacttctagctccattaggtggaagagtcccgcctgtacgtcgtccatcacagccctgtggccggtgacgttcagacgccactttggattcgggttcggcccaaaaccgacaagatccccccaagtgacactctggcaacgttcagcaaaacgaacttgctcgtcagtccagagctcctttctcccggccagaagattaaatattattatctaggaataatatataaaattaaaatatatatagattataagaatatttaatattataatagttagataacttatactagatagagatctagagtagattagggttaaactaattagagtattattctgaataatataatcagattattataagctatataatataagttactattaatatataagtattatagagctagtaataatagatatatagataatattattaataactactaagaaagtatttctattttaaataaactaaatatatatatatactagatagcttatataggcttactagtaatccggagtaagtctgatcttagattatatagacttactaataatccggagtaatctattcttaattagtaaaaaaaaatagaatatactatataatatagtagatatttactttatttataatatattactccctccctattagttttatctctaagaccagttcttatagctaatagctagtatataatcttctttatcttttacttattttatatattactaactatattataatttttatctaagaagttataatagtataagtgttggtatactaaatacctcctactagcagtcacggcctggaagcctgttacagagcggtatgcttagtcacgaccgctctggaaccggctttataaccggcccaactctgtagctaggatagtaactcaatcaataacttttacacctatctatctacaagcgtacgctttggaaaagccttccaacaataagtattttatatctctaattaaaaagataggtattaaaattatatcttatttaaattattttaagtataagagggtatattatataattaaggcttcttcttattatagggagtatataaagttagattaatcttataatagtattaaagtagtatcttagtatatataattttttattcttatcttttctaaatccctactaatttttatttatagtaaaatatttagttactaaagagtagtaattagaaaataaattagctttatttaaattagctctttaagaagctttagtaaaaatctcttatctttattattaatatcaggtagctcaggagaaattctaatatctattttattatagggtatataatctagataagtagaatagtatttatactcaggaggaggtaatccttaaagagcagtaggctatagatatagtatagtctttagatactataggaattattaactagactttaattctactagagttctctacttcttccttattccctattaataaaactactatataaactaatagtaattctttaagtatttaatagattcctatatattcttatttttattatagtctttctattttactaaataaaatatttatttattcttaatttctttctttaggattttttctagtttatattcttctttatagatcttaattagataatcttagtttagagtatttcctaatatctttttaagtagtaagatataaaagactagataaatatatattatatctaataataaaagtttatagttagtatctgattttttcttaataattttaaatagtttaagttttttataatctaatttattatttagctttattattataatatttttataaagtagatagatcttatctcccttctttaaaattaatccctttaattttattttattataatattcttttattttttcttagagaaattctaattctatttttattttagtatataataaatatagtatttcttttataagtatagtagctagtatatctagtttattaaattctaattaattctagaattcagatttataactatagtttatatatattagtaataattagattaatttttatactaaattattatatataatttatactattagtaatagttatatctaattattctatttataattaatatatatttataggtattattttagagtttagtttaaatattctatttaactattactttatagatagtaagctattaaaagcttatattttatatctatttatactataaataattactagaacttaaagataaatattatttccctatctaatattattttattagatagtttataatagctaactatatattatagaaattagtatataaagtcttctatagagcttacttccttatatagaataaagtatttatactttataaatctattaataattattagaatactattatattctattctagttattagttctttagattttaatagtttaataatataattaaagaatattaattactatagttattctaatactaagattagtttaagttctctatatagtttatattatatagacttaatttatatatatatattatattctgaaactataatctatactttcttttataaatctagataattataatattatttaattctattaaatattttcttaactctttagtattctaagagtaaatacttatagatttccttaataaatattatttttatttcctattataatttttctaagctaggaatagtatctatctagatcttaatatatattatcttcttaaatatagctcctaaggctttttatactaagtattctttattatttatagtaagtaactatttatttattttagatatagtttatttatattctaatttatagctaaaagtattagctcttcaattttctaattctttttagtatattatcttataattaaattagaataagtatttagtataatagatttatttcctattaaattattagattatagtaaaatattaaatatttttataatctatatatatcttaatcttatatattattcctaagtaatagtatttaaattctttaaatatatatataatagttataaattccttattatagatagagtagttaaactctatactatatagtttctttaagaagaatactatagggtataatactctattattatctctttaactaagttatatattaattataaaatctaaaatattaattttattaaatactttttattagttatttttctattagaattctttctttttttttatagtattatatagagatatagtaattcttttataattcttaataaattattaatagtaattagtaaaactaagaaaagtttatactttcttaataatttttagtattttctagtctttaattatagtaactttattttattctatttatattttatttaactaaatagtatattctaagaagttaatttcttatatatagaaataacttttctctagttctactaagagttttatattttctaatttctttaagatcttatatatatattccttatatatttctagattatctaagaagattaaaatattattaagataaataactataaaaatattaagatattcctagagtatttaattaattatttattagaatattataaatatatttattagtctaaagagtattataaagtatttatagagattaaactttattctaaatactattttctatttattattttttttaatttatattaaattataagctccctttagatctagtataataaactactatttcctctatagctagtctctaagttctataattagtagtaagagtattctatctttatatataatcttatttagctattagtaattaataactaaatagagtttattattcttttttaatataaatattatagagtattctataaataaagttaataattatatatagtcttttattaatatattattaatatatttataaagtttttttaaatagtttattataaacttagtattcttttagaatattctttagctattcttcttcctctaaatattttaccttagtatacttatactaggtattcttttttatattctattatatcttttattagttatttatttagctctattcctaaatcctaatattaaatagttctagaggtagtttttctattcttttactattagctatatctagttttatactcttattattattcttctattagctattcctaattaattagtactagatctatttctaagagctattcttatttctatatctaatctaagatctatattatttatcttaatttttattataataagctttttatatttctagattataatactattaaaattataattactatatctacttattattataagttattattattttttataatagtatttttagatattaaaaaatagatatatttttctagtatctaataaaattttaatttttattaattctaatttaaatacttagaagagtactattactctatatagttagtatactaattaattagtaagtttatattttataattataatagttctaatataatattatagcttcctagtagtattaagttatatataatattaaatttcttttcttagattttaattataagataattagtctctaagttaataattctattattatatttaaattttaagctttctatattagctactatataggtttctttcttttttctttataataagtagaattagttaattactactagtaagatataattctcctatactctatagttaataaatattataaactagttccttttaatctctatttctataagaatataaatagagcttctagtttctattacttctagagttctctaatctattattaatattatactaacgtgatccaccaccatgtgggccataccaccatgtgggccactttccttaattttttatatcttcttcttctaattagtataactcaacaacctaatacaatgacactaagtgaagaacatcaaattactcttgctcttcaggccttacaatctacaaaaacattaagcatccggaaggctgctaaaatctacaatatcagccggacaacactaagccgtcgaaagaagggtagaagcgaccgagatgcgtttgctatcaaaacacggaagcttacaatcttagaggaagacgttgttcttcagaggattcttgatctagattcccaagcatttttctagctctgatactggcagtatttcaagtagcttaaatgaagatagctagctaggaggcatcttgaccaggcctggctgaaaaccggccttggggagctggtctagcctaaaggtatatatctcggctaagcctagctaagatatttctaaagctagcctataggtagacctaaataagatctataaaatgtattagtttaaatggtttagtattaatagaggaggaattctcttctaagttatagtaggaagaggtaaagagagattaggggaaaagggttatttattcaattaaccccacttttaaataaagatctattataagaatattatttttagatataaaataataaaataagtatagaaaaggtttaatttcttcttttattatcttggttaataagtaaaaataattagaagttataaagtttaaaaaagtggcccacatggtggtatggcccacatggtggtggatcacgttatttctaacttttttctttagaattttctctagtttatattcttctttatagattttaattaaatagttttaatttagagtattttctaatatttttttaagtaataagatataaaaaactagataaatatatattatatctaataataaaagtttataattaatatctgattttttctttaaaattttaaatagtttaaattttttataatctagtttattatttagctttattattataatatttttataaagtagatagatcttattttccttctttagaattaattcttttaatcttattttattatagtatttttttattcttttctagagaaattctagttctatttttattttaatatataataaatataatatttcttttataagtatagtaataaatatatctagtttattaaattctaattaattctagaatttagatttataattatagtttatatatattagtaataattagattaattcttatattaaactattatatattttttttaggggtttttactatatataaagagtaatatcctaagatcaggctatatataatataatctatataattagtttttaattaagttctaatctatatctaagaaactttaactctaatttttttactttttattatatagctagctaagatatagataatagtaactctaaaaactctaagaagagcttattaaatatataatttaactatagaccctaaagggagatacttattatctataattaactataatatctctctaagcttattattactaactacctcttcttataactatttattactaactaccttttataatagtaataataaatatctctaatataattattctctataactaaagcctgattattataagtaactaggtccttatatatataataatagttattagtaataactattagaatctctttttagatattaattatttaagcctatactctattatagatttacttaacgtgatccaccaccatgtgggccataccaccatgtgggccactttccttaattttttatatcttcttcttctaattagtataactcaacaacctaatacaatgacactaagtgaagaacatcaaattactcttgctcttcaggccttacaatctacaaaaacattaagcatccggaaggctgctaaaatctacaatatcagccggacaacactaagccgtcgaaagaagggtagaagcgaccgagatgcgtttgccatcaaaacacggaagcttacaatcttagaggaagacgttgttcttcagaggattcttgatctagattcccaagcattttctccccgattacgcgaggnnnnnnnnnnnnnnnnnnnnnnnnnnnnnnnnnnnnnnnnnnnnnnnnnnctcctcaagacagttctatcgcggaaatatgattatcagagggctctttgtgaggatccaaagatcattcgcccttggtttgaccttgttcgcaactttacggctaagtatggcattccggaagatgatatctacaattttgacgagactggctttatgatgggccagattcaaccacatatggtcgttacacgctcagatcgggttggaaagcctcatttggctcagcctggtaatcgggaatgggctacagcaatccaggccattaatgcattgggctgggcagttccgccatacttgattgttaagggccaatatcatcttgcatcttggactcacgacaaccatttaccactcgactggcggattgcagtcagtaaaaatggatggactacaaatgagattggtctagattggattaaacactttgatcaatctacaaagacgcgtgtgaagggcaaatatcgccttcttattctggatggctatgagagctaccactcaatggaatttgagtcctattgtcgagataatgatattaagactctctgtatgcctcctcactcctctcatattcttcagccacttgatgtaggtgtttttggcccattaaaaacagcctatggccgctaaattgagcatcttatgaaggcacggattacctatattacaaaggaagatttcttccctgtatttctagaagcatttaatacctctataacctaggaaaatatccaggggggttttagaggagctggacttgttcctttagatgcaaaaagggttctttcaaagctggatgtacgattattaacaccaacaccgccaggcacccctctggaactgcctacagtttgggaatcaaagacgccaaacaacccaattgaggctacttcacagtctgaatacttgcgaaatagggtaatacggcatcagaacagctctccatctccaattcttgatggaatcaataagattgcaaagggtacacagcgtgttatgcatgaggtggcaatcctacgtgaggaggnnnnnnnnnnnnnnnnnnnnnnnnnnnnnnnnnnnnnnnnnnnnnnnnnngagccaccactcaatggaatttgagtcctattgtcgagataatgacattaagactctctgtatgcctcctcactcctcttatattcttcagccacttgatgtaggcgtttttggcccattaaaaacagcctatggccgccaaattgagcatcttatgaaggcacggattacctatattacaaaggaagatttcttccctgnatttctagaagcatttaatacctctataacccaggaaaatatccaggggggttttagaggagctggacttattcctttagatgcaaaaagggttctttcaaagctggatgtatgattattaacaccaacaccgccaggcacccctctggaactgcctacagtttgggaatcaaagacgccaaataacccaattgaggctacttcacagtctgaatacttgcgaaatagggtaatacggcattagaacagctctctatctccaattcttgatggaatcaataagattgcaaagggtatacagcgtgttatgcatgaggtggcaatcctatgtgaggaggttgctactcttcggaaggcaaatgaggcactaagcaagcgccggagagctaaaaaaacacgtctacgacaaggaggatccttaaatgtacaggaatcacaggatatagtagcccaacaggaggttaatagtcagattacccaggaagagcacttgggtcggggtcggaagccacgggataagacccgtgttcgacgatgtggtatatgtggtaagacaggacataatgcacggacttgtcagatagttgtagagctatctagctctgatactggcagtatttcaagtagcttaaatgaagatagctagctaggaggtatcttgaccaggcctggccgaaaaccggccttggggagctggtctagcctaaaggtatatatctcggccaagcctagctctaggtcctcgggctgagctgcgcaccttggtctcatggcctacgggcatgacaaacctcgtctcttggtccgcatccagtttcatcgttgcatttactgctttttctaattctgtcccttttacctgtcgtagcttcgctgttctttgagaaacgaaagtatctcgtgcccaaccccctcctcatgggaccacaacgcccctccttggccaatcaacggagccgcacacaagtcccttatgggcccccttcagggtacactgcctactggctccctactttccgcaccgttttcgtttaccgcccaacgggttagatgccgattcgtttcgctattggccgtcctttattcctgtccttgtgtccatccggctcaacgaaccctgtcgccgttcgaccagagactatccaccggcgactcgaagtggagtatcattggccgagccgggactgcttcgtcggagtgaccaccggagcaagtcaggacgtgttgttggtttagcccctcgcttcttccaagttggttgggatggaaaaaagagaacaactcttttctatggcttaatggtatccccgggtgcggcaagaccattcttagttctaccaccattacggatcttgactctaccaactctaatcctaaagtacaaacgggctgcaggcttatatgcatatgtatatacatatacatactagtacttgcatgtatgtatggagagtaaagtatgcagaaattattcatgaaactaaggtgccttcattcctactaggcgatcgagaacagtcttgcatcacgtgtgtggtgataacattattagctatcgcataaagtctcgatgtattgtggctgagactagccttttgactttttttgacaattgtaagtaggtgatactcctcctttgccggccctccgccctccgccgttctccagacgctggtttcactccatccgtggcaaagcgtataagagtcctccatcactctgctatggaatgctcttgatgttgagaggctagcccctttaggacggctgaactgaccatcagcgcttaattacgattgtttacaatggcggcctaccaagaagagttaggcaaaagattgtgtgtttgaagattatattggaaagacttgcttgcattagctgcatagagtatagtttgctaatttatactaaagttgagatgtgtaattctgacgttaagattgatatagggccgctatttttcctaagattaaaaggcttataaaatctataaaaactttcttatttttattaatctatttaaaattcttaatctccttttattattaaataaatataatatagttcttaaatttaaaagaactaaatatcttaataaataaattaaattatatataaagaaagtaattactgttgagatttaccctatagactatagggtagatcagattgccctatattagttgatcaaatgatcttatattagtatagggtaaggaggaatgaaataactaacttagggcttcctaaagctggaagcccgctgaagccactggcccaacccactgtggctgcccgttggggcaattgcgttagcggtcacaaccgctgtaacagccgctgtggcgtccgtgctagcgatcccgtattgcgctgaagcagctgcattagcggacttcgtgtccgctacagcgcttacattagcggacctcgtatccgctgtacgagaaccttagcacttagtttagtgaacctcgtaaccactatagcagctgcattagcggacttcgtgtccgctgtagcgcctgcattagcggtctcgtatccctctgtacgagaaccttatagcggttacgagcccgtattaaaatgttggtcgataagtttgcgaacacccgccccacacaccataatcgtatcaacaccgccaactttgaactgtaaataactcttccaattatagtctaaatttgaagctcgtgataccgtatgaaagctaggatttcggagtttaataacgtgtataatatccccttgcgcgacgcacagcgcgcagccggcgcggcagtgactctatcagcttccgcggcaggtctggcggcaatgcctcccacgccaactcaaggcatttgatcaattcggctctatcggctgcgttgtttttgagatatcgaagatgagggaacattcttcctaatttcctcttgagagcagcccacataggttcagtcggatttaaatcaggtgagtgaggaggccagtcaatgtacgagatcgcgtgttcttgcagccactcaggagatcccccaaagttgtgaattcgcgcattatcctgttgaaattgacgggttccatcgtatataggaagaagcccttcctcgagtgcattttgatagctaatagcggaataacctctccttagagcgtttagatcgcgctccataataacaagcttgctcttgccgcctctccagatcgctgcccacaccatgcaatgaacccgaaggtttacccattcagctaggaacttctcataaggctttcggaagacccaatggcgtgggttgttagattccgactgtacagttgactcatctgagaatatcgtctggaacgcattaagtagctggaccacagggcaagggaaactcggccgtacctccatcaattcttcgatatccgacccccaggcttttgcccaagatagcctgatctttgctgtttcttttgatatagggatccttttttttgaaagtcatttgcgcttgaagacttgccggagcgcgaggcgtagggtccctcgtgttaacgcgatgaccggtcgcatctagcaacgcgttgtaagtgatcttcctctctttcttagctaaaataacaagatatctgacttctgcaggtgttaatttaggtggtctcccagatctaggagctatatcgaaagagcgggtgtttttccagcgtttgaagatcccgtacgcggtggatgccctcgtgttgtattcttccgcgacagcgcgataggtattaccgctccataactcagcgcacattgcagatttttgctcgggagaaaattgacagcctctttggcgatttgcgcttatttcagtgccaaaggcacgctttggagtcttcatgttctgaagttattgtgctttgaagataataggggtgggagggttgaagacgcgaaaacgcggtgtgggtcggggtgttcgcaaacttatcgaccataatagtacagaaggcaacgtgttatcttcagggcccttacggccgggaaacacctataagtacagggcttcctccctgctagatagagattctttaagccaacaattcactcttttatctaccctacggtctatcttcttagctaccctgtagctgataaagcctttatttcttactaagagcctgcctcttctactacgcctttcgaaacgatcccttcagtattccttagcctaccctgtaggctgcacctaccctagacccagcttaccctatagctggtctaccctatactggaggccttgacctttcaaaaattactactttagaaatctaaatctaattagctaattattaattttacttttttaattttctttagtattttacaatatactttttacacttatttcctttaaagcttattatttatattatatatatctttaagattcttaaagaaaaagaatatattattattatatttatttttaagccttagtatatatatttatatatagtaagagcttatataattaagtatttaattaaatatattatatattctatttatttctttattaaatagagctagtttagtataataattagtatatttaatctttaatttctcttagttttttaaaaagtaatttaaagaagaaagaagtagttgatttatagagggtcagagaccaactaacagcaactaatagtggaagtaacgcctaactaacaaagacttattcactataactaaggcttttaactgctataacttagcgagtttaagggctaggaacttcaggtttcaactaataagtgtattttcgaactattgagaggtgtaggttatctacttttcctctcatatatctaccgacctatatttaccctaaaacccgctacagcagctttagtagccaattttgattttccgcaaaattcattagtataagaaatctaaaaaatcgactcacaaccactaaaccctaagacgaatatgtataacttttataagacccacttttatctgaaagaggcttaaaagacaagtatttgagtatagatatctaatatcttatctcttaaactgaaagagttatttcagtttcaaaagttactatagggtaagttgattatagggtagcgcaggtcccgggtaacctaatactcttttcccgggtttcctagctaacccctagggctataactagcctaaaacagctagcggttcataagaggctagttgttagacttgtctcttgcgttactatctcctttaattcaacagaagtaagcttagttccttaaataataaatattttgttattttaaagcctattagtaacttttactatatagtttaaataatctaactttaaaagctctagctattttaatttattaaaattacttagatcttataattaagctagatagaaaacccttttaattatagttttaatagtatatctttatttaaaaaaatcctagttatttaaattctttaagatatataatattatagatattctaattcttttattataagatttaatctagatatctatagattattttacttatttagtacttatttaaatagttctaactattttaaagaagtataactttaaaactcttaattattagattataaactatagataggaaaaattagataattatatttttctaaattatatatctttaatacttccggaggaaattattatataaattactataagctactcctttaggcctaatacttttctaaattaggaaataagatatatttttattttatataaataaaatatttattctttttaatccttttattaaatatcttttctaatttatatttttctttataaatcttaattaaataatcttagtttaatatattttctaattttttttaaataataaaatataaaaaattaagtagatatatattatatttagtaaaattttgtatctaatatacttatagacacctattataagttagcgacgtgttaggtacatataaagccattaatttggttagttgtcgtatctattgcctgcttcagtggttagtgctgcctgcagagtgagaggagactaggtgtcagtcgcccgcagtcacaaaaagtggaggaggtcttatcggcaagcgattgccaagggcaaataaccttgccaaagttcgtgaagcatggtttaagcgaagggtcgcgactcgcagccgctctcaaatcatgcgtactcatcacatatgacgcagggtaagctttactacgagagttgagccctccattttccatggcgaacaggagcgtcagactgataggtgctgacatcttcttgcattgaggtgctgatttatgtggctttcagataacttatttaatccaatttgaatatctaggtggatttgagaagacaaggcaagttttagtcttctgcttctggcactaaaaaaagaaactagaagagatttacacacctcaggaagctaaatgagcctggttttatccccccgtcaatagcccgtactagcggcaacgcttgtcgatctcgactgtaacatgaaccttgatcttaaccgcatctccacccaactaaattcttaccgtttccactgccgcctatccggcgggttcataataagcttcgcataatttcccccctctaaagagagggtgacacagaccgtatctttggacgcattcgtatctttttgtcaccctatagtaattatactggatgacaaaaacctgcatagaataatagggtgcgaaatatagtatgagatattgtgttctgcttgactatttctatcaccttactatagattatatagggtgacaaaaagatacgaatacgtccaaagatacggtccgtgtcaccccctctttagggggggaaattatgcgaagcttatgaacctgccggatatgggccattcgcacaaccaaggccatcttcaaaccccacaatttcatccagtgactaccgagctaggcccatttgaccgttttgggccactactcgggaagtgcttgatatgtagatcgtatcgttcacttccagcaaggcagccaaggctagtatgtccgaaatcttagacggatggtaaagccctagggtcgttcagttcgtctgtacgtattagcattgctgactgcggccattggttgcgggaatttccttagttcatgtttttaacaagttatttagattcttaaaccgtactcgtgccgcaacagcctcatgacctcacctgaaatttctcttaccatcgtcaaatgaatgggtctaatcttcatctagcaccggggatactgggtgcctagaacacggtctatgtattgtaaattcagcaaggggtcctgagctggggctccgtcgttgtggttcctcgaccttgagaggtaagcgctgacttacccaaatcagaaatccccactccaaactcacctcgtaaattgttgaccacttaaaatccttgaatagtcggcaatgcaaacacccgtagagttagcccgacgcctacacacgataattgcgcattcacgtaatagcacatatcgtatcctatttccgtctcctgctgttcttgtcgtctttgctggtaaccccgaccctgtcatccaatggcagtgcaacctctgggctttctcattcgtgagacggattgacggaggaaacggagtcgctgaaaatgccttgattttcggtgctaaatttcttctgcgatctctgtttcttaattcctcctttcgtctcttttgctgttgcaacttctgctgcttgaactgttgcaggaaacaagttgcagaccacaaagatggtccgcctcagtgtcgttgtcccgctttccatgatactatctcaaacccttggtcatgaggtggacagttcagatgagaggcatcttataggtgcctacatatttgagttcaataaccatgtatgcaattcataatattttctttccgatcgttaatcaccttaattgtgttgctgttttagtttgggtatttacttctatgaccctgctaacgcttttacaggaccggtcagacttcgattcccacattgctgccaacgggagaacaagagcagagctcaactatacattattccaaggtgtttcagttcagtttaccgacctggaaaattccgcaagagtggcggaaagcatagctaagcttccagttgtgaagagaatgtggcctgtcagggttcacaagagtgtcaagccacacgttgagtggcagggcacgccgggccaggattatattctttctaacgaaaagcgccatgcgcagagcgatgattttgcacctcatgttatgacccaggttgacaagttgcgacaagaagggtatactggtcagggcatcaagattgctgtggttgacagtggtgtaagtgaagatttcttatactatttcctctcaggcaaaagctgattaatggcattttccccagattgactacaaacatcctgctctcggaggatgttttggtccaaactgcttggtctcatttggcgcagatttaattggcgatgatttcaacggtgaaaacgaattcatctatggcgatgatcctatggactgccaaggtcatggtactcacgtttcaggtatcattgccgctcaagaaaacccattccacttcaccggcgcggctcctggggttgagctaggcgcctaccgggtttttggttgtcagggtggcacctcggacgatgcagcaattgctgcctttaaccaggcttatgaggatggtgccgacatcatcaccgcttccttgggtggtcctcgaggatgggctgagagtgcccctgctcttgctatttctcgcatcgttgatcagggagttccatgcttagtcgctgtgggtaactctgggtcagaaggcatctttttcctaggtggcccagccgaaggcacccgcgaactcgggcctatctcgtcggcttctgattttctgatatgagcaacacagttactgtaccgacatgaaaattgggcactggaagacaaccatccagaatcttaagctcgaaacgacgcaagacttcttcctgtacgtctgcgaaagatccaaaatcacatcatggggcaccggcgaggagtacattcgtcagttccagcagctatacacaacggtcactggccagtacatggaccggaatgacgccaaggaagtatacaaggtaggtggactccttcaattgtatgggcgcagctagctgctgttctatgcaccgtatgagctctgctgatagataggactgatcctatgttcagtcgatggttcttacctctaagcttattcggcgtcactgaagtcgcgcatttcgtggcaagagaggaagagcttgcacaaatacataagattttgcgagctaacgacggacgatgcactgctatcctatatagcttaggtaggatgggtaagacgcaactggcggcagcatacattaaacaccaccatacagattactccgccgttatctggctgaacgctaaaatgcaacatcgttaaagcaaagtttcgctcatgtggccgagaggatcaatcaacagcatccctccacactctacattaagaatgccatcaaggacaaggatctcgattagataaccaaggcggtcaagcgatggctgggagagactcacaacagccgttagctcgccatttataataattacaacaacccaaaattctacaaatccacaagtggactagagacaagcaaagagattgtaaagagcgaatctagtgcgacaaaccttaaatctcagatatcactagagaaagggtttaatattcaacccttctttcccagtagttatcagggtgccatccttataacaacacgatcatctaccgtccagcttggaaagattgttcaactagggatattaataaatatttataatagcctttagattttagcttccacatcacatcaacagggccttaataacagtataccacggttgatggaacatgatagataaggtcaatacactaacgtagtttaaatagatgatgccgctctacaactcgtgcagcaactcgataggcttccccttgctctatccaccgccggctcttatcttagtcaagtatcaacaagctgggccgagtacctagagctttacaataaatcatggctatgagttcaacatactagtccacagctacttacctataactacgcaatatacaccacctgggatatttcatacaggtatattaagcaagatgataaagttaccactaagctgcttcagttgtgggcatattttaacaacgaagacttatagttcgagctactacaaagtggtgcatcagaagcatcgaattggctgctacaagctgtgcaagaccgactctcctttgaccagacgataaaagtactttacagccatgggcttgttaaagctgacccaccgatgggaaaatagggcacacagtctaacggatatagcgtgcatggatgcgtgcactcctggatggtgcacgtactgaacgaggggaccaatgaagatatgtctaagctagcaataagatgtgtagcgttacatgcacctagtagagaggtggcagagtattggttggtccagagacatctacttcgacacgcagatcgatatcacacgatgctggcaaaaactcaaaaactgcaaaatcataagtggatccctggagtgctggggaatctctacgcaagccgaggtcgatggaaggaggcagaagatatatacaatcgtgcacttcaaggctacgagaaggcatggggaccagaacacacatcaactctctccacagttaataatctcggcaatctctacgttagtcaaggtcgattgaaagaagcagaagacatgtataagcgcgcacttgaaggctatgagaaagcactaggggtccccatggtggacactttaccctcggcgctgaatactctggagaatcttacagacttattatgtgatgttggtcggcttaatgaggcacagaaatactatcttcgtgcagaaggtggttttagacttgtgtacgggtctgagagtgaaaaccatcaaagactttcctctaagttacaagttcatgattagggtagggtgtatttactgtcggaaatagagagatagcagtctagccagtttgtcattgagtttgttacttttccgcgtttattcgatcaagagttaagattagataatcgcagatgcgaagtatcctaaaacctcatgcatggtactggcagtcagttcgcactgtagctagtggataccgctatacttaaaaaagctacatagcatttatacttgagattacatcaatatacattgtgtctggatgaaacagccaattgtggctgctatgggtgggtctaagagctgaggtggggtcagttttggacctagtaaggtttacctttgtaccgcaaagtatctggcttagtttacagaaaacgattgtaagacgaaagaggagcatggttttgcacaaaactgtatcaaatgtgagatacacgggatttccagaaccattcagtaaacgttggtattactaatccagtgtataatgccaatgctaatcttcgaaggaaccaacatgctactatcgcatccacaagcgaagccacagatgtacatatcatccaaggacgtcccttggaatatcgaattactgcgacatagatttgaattacgtaagaataagtagatgaaagtaaaaccaaagactcatcagaattgatgtaatagtgtttggttgtaatcctgattcatctggctcttcgttatagcattgggtaagtataaatgggacgcgctctcgcgttgtcaaccagtagtttgaatcggacatttgttaaatgatagaattctctgatagaattctctgatcctattgccagagacctagaattatgtaatatttccacctaagccatccagatgcttgaacgccgtatgcacgtttaagtggctataaccatattgccaagagtatgttgttgaatcgccgccttagccatgattgccataataaccggatcaacaatatgtccccccatcctattccaggaagcgaaattcaggctaaggtggttaatatcataaataatgtctcataatgcaacttatctctcctatccatcttgctgttactgaccattggccatctttatctgtttatgtactttcatggttctaaattataataacctcgacgctttgctaataacgctgataatactataaagactaaacagtcaacctagttcttgtataagttgcccagattgcgtagtcaagagaccccaacaaatgaatacaccattatgagtatttgcaaaaattctcctgttcatggcgaatatagatagattcaccgcaaaggaaatagaaatctaggttaaaaccataggaggattagacacgttatcactgaagagctataagaggcgcatggctgaaagtttataagggcgaagattaaactgttacatgaaccagtattctaagttagaggcttatcatcaggtatgtggtttccagacagcagactcacgagagcaaccatggcctgaagtgtcaccgttacaaaaagactcggcaccctttctgacttgttcacatccgtaacaacacgccttccgtcggaaaaggatccgaacataaaccaggtcggggagatctagtgacagcacctgccttgaggccgaccctccggatatcggcatatacctgaagattttgctcggctatttgggataagggctcccagtgactggatcgcccgccagcttttctttggctatatatctacagaaattattggtgacgaattcatccttcaaattaatcggctgcgcggtggaacttactatatatgtagaagtgcccaggaagaagtagccgagctaacgaaaactcatcgttctagttttttacaggttaacaacccctgtcgctagttggtaagaaaaatgaccattccgtcaggatggcatgactcgcgcgggctttcactcccgaagataagcagcctgccggtgccagacgtcaagcattatcatcagtcggtgcctgcagtctcggccaaagtcgctttccacttggtggcttggacctgtatgtgatgagcaatcaatggccctttgaacagcgcagcagctctcccgcgctgggctgtatgtaactggactgccatttcagttgacgatactgagtgtgccgaggggtcttggcacgttgagtcgaaccaggggggccgcaggatgtgatttagaaaactgggtgctaccaatgcaggtgatgcattcaatgtgactaggtaactatcctccttctgtgactacctagctgtcggcgccagcgcagcagatgcaacgactcccgatttgctgctgcccctgatcaactcccaaagggacaacggggaatgggtgctgattcgacgccatcttgaataccgacaatttgtcgattcaatattggcaagtacgtcgcattgaagccagaggtcgcactcttgcccttatacatcaaaatctctccaagaagctcgtccggatgtccatgacagggctcagagatgaaccggcaagcagttgcggcagagatgaaaagcggccttgcgagatccactacagccttgaccctcgaatcgcctagccattctggggctagccgtgtttccgttacagtgaggttataagtttcccgtattagttgaaactggtgctctagaaatatcaatatgtcgcggtcaatgactttggatctgttttcgtgaagaattaagtcttggtaggtgccctgtgcctttgcgaaactaaggcggatcggcatatctggcctgctagtcataaagactttcagccaggatatttgtggcgattgtacacgggcaaagagatggacaatgtttccaatcttatcatcgccttcgcattcgtctagcgcatccacaatgatgacgagtggatccgatagcgtgattttcgataagggcttaaagattaatttctggaactgctcctgaatgcctgagcccgatatcatcgagtcggtatcgatcacgtccacaagcatcgatgctatcttcagtattctatcggcgagctgacgggctattgtcgtcatgaatttagcggcatttcctctatcagcctctcctctcttgaagaagaagctggcaccgagttggttcgtctcagacagcgagcgagcaatggtccgcgatatggttgactttcccgttccagcatatcattcaaagtaggtggaggctttctttagtatgttacagcttatcagataattctgatgtgccatagccttattctaaccagtgtctagtatattctaggcttatgaaatttaaagacatggtgtccaccggttaggtattgggctaggattatcctgaaggagactagcaattggatggctatccaaggtcatggcgacatgaaggtcgataacacggtaagaatttagtttgtggagacactaataagaaagaagctcaccgtattagcactaattcggcattgatcaggatccgaacccaggtgcattatgattggttgtaaattgcgagcatgccgacctcttcccgagatgccttgaatcctggaatttgcgcccagagtagtaagaataccccagaagccacggagttaatggcaaatgagatagaagtctccattcttcaacccatccagtgcagttgcctcctgctaatagcacaccgatcattaaagatacaatgccgtacggcatagatgaagacccaacaccgtctctcttgtcgttattccgagcagcatcgaatgcgagcgtagcctgagtagggactcgattgctcacgaatgccactaagaagtgagtggcggtcttttcccctgagcaatctttgttggatatgagtccctatcaatgccttcgcacaggcacacacacccttggctcaggttcccaccgttttctctccacaaatgcgagccctgaaggtcggtccgaaaacgagaagtggggtcgagcaagacgcctttatgctggtacaggagtacaaatgtacaaattcaatttacttttgaagtgaatacatgcactttgatgatttggatttttggcttttgtggttttagaattaactaatcacgatagagaacaaattcgttccaaattctccactcgatacagaaaggactcggctttctgaaaagtgtgacatttatccccatgtctccatctggtcctattgttgcatcagatatgcgcaagtgctcagggattccgaaaggcgcctcagagcattgacctgtcggttttaaggtcggcacctctatactctgtgttaaataataaggatccggagtagatgttgaagaaaacccattcgatgaacttgccggccatgaggttttaaacccaaagtccgcaattgaagggccagtgatgggtttggtggctgactctgcggaaacgtccgattcttcttcgaatgatgaactgtaccccagcagagttggcgtaattgagtctgtgcgagcaagacccccaacgaggttgtaaggtttaggcttcgtatgctctgtacaatctaaattcgaatcccaatgaattctagttttggcttctggcaagtcaatgaaagtcgctgcaggaggggcttggaattgagtgcctttgtctgagacccctccgaatttctgtgtaacctcaaagggtaaatccggcataccgtgtcgctggcaaggacggcgtaaagttgccagcgaaggtgaacgtagctgtctctgctcttgtcggaacttcttcccggcttctgcctcaatataaatcatgcgagaggctatatgcgctaaggtttgcgccctccaaagattctcctgacggtctccatgtcttaacagaagctcaacagcaccttgccttatatggggatgtcgacacttggctgctgtgagaaacaacactggtacaatacctgtctcaaaagtaaagacaagctttccatggtactcttcgttgggctttctggctgccttctgttgtggatcctccaccttttccgagtgctcacattccttagacgctcccgtgtctagtgtctcaggacttgcctttgcggcttctaaatatgccgcgcagagagggataatggcgctaaaccgctctatatgctcatcgaatgctctttctgcctcacacattgctgtggaagtccaaataatgatggtatggtataggatttcgagtagtatcattgaaggtgtcggtgtcaatgaacttgtcttggagattcttagaattgaaaaggccgtattccatttcgaaatacgcgacaagagtgattccttctcccgttcgaaatctcgtatctcgtgcggcgtgagtggctcattgttactgtggttggttttataggcaaaatcagtaggaacccgagggtcccgccgctgcctcgttttccaaagaaaccgccaacgtagtgagtcgtctagaatggtataaaacacgtgtcttgcatgaagcacggaagagaattcgtcaggaatctccaaatacgggttgaggctctttgggatgggcaaggtgtctattccgaataaaaagggcgtcaatcctgacctcatgtacatcggtactatatgctggcgaataaggtcggcttgcgcactctgtagacactttgactgcaacgttgtatgaagaagttggcgtccttggcgcaggtgaatgagagcctcgacttttttcatctgcatgaattctaagcagacgaataaaacacataaaagtagaggcacaaggggttcgtgatgatctgcagagctaatccgctcacgcagcagtgaaattgctttgttgtactgctgcaacgcgaatatttgcggtttggtaagctcagtatttcgagttgtactgttctagatgaggctttcatgcaaactgcttatagcaagcaccgcatgtcttactgacggtatcatatgagagaactggagaaccgtagccacccaaaagcccgaatcgtagtccgaagaaaatttcggcccagtgatacttcggaagaagtcgaaggatcgttgttcgttgtttgatctgagatcagggatgactttcacagcgggtaacaagatcggttttcctttgggagcagctggtctggggttctgagccagacgatcagcttcatacccatcacaatgctggccatatctcgtgcatctcatgcagaccggtttctgctcgtcgctggagtgcaatctaaatcagcgttttccgccacgtgcactagcggcaggttgtgctgtatgactgctactgtcccaacacaangcgtcttgttatgcctgacgacattctgcctctcgccctacactgtccgatcaaccacctctcgtcccgacagtctgttaagcatggattttgtcggtggagctctgcattgcgcaatttccattctcttgccgtgcgcgttgatcatgtctggcatatcctggtcatggaacagctcctcgactattatcacctgggtctttcttgccatcatattcatcgtctacattgtgcagcaaaagtacgccttgttaaccagctctaagaacagagtcttccctgttgatgcgctcactcatcgaatcgctgggttagctgccctcggtgccgcctgctctgggattacctacgctatcagcttatactatcttccactcttctatgcctttgtgcgcggagcctcaccacttgaagctgcggttcatgttataccatttatttgtttcttcattctcagcatcattcttgccagtattgcgttgcctcttgttggctattatgcaccgttcttcgcccttgccggtatccttatgcttgttggcggtgtcttaatgacgactattactagtgcaacatctgaccgaactatttttggctatcaggtgctcctggcgattggggttggtctgatcttctccaacgcttacagcgtagccaatgcatcgctcaaaagacctggagagcggattgccgctgccgcacttttcaacatggcgtcattcagcggtatctgtttggcactggcagtagcaggctcgctgtaccataatgtcgggatgctcttgcttcagaaggaacttgcacaatacgggcttgatcgtgtatatatcagcgaggcgttggcgggcgtagcatcgcctgcatttcaagctaacgcacgcatcctagagtctttgcaggagactgtgtcgattgtggtgtcaagcctgttctatattgtggtgtttgcaggggcggtgtgcctacttgctagtctgatgatgaggtgggagaagcttgatttcaagccgaaggcagagcaggaaggggatggagaggaaagggacaacgtaattcagttgaccatccccagcagtagtccaccatgactttggtcaagtatgtccagcaaagtcaaacagcaaataggttacgtttctaatatgggagctagtgcagtttaaatgtggttacactccttttttacgtcagaatcaaggataatagtttgaaatggtgcgcttatcaactcgaagagtgatagaggttgtacgtaacataaggagtctagtgactagcccagccgcgtcttagtctgtcttggtaaaacgaaccgtttatctgactccctttatcactcgaacattgcctcaattcctatatcgttttgatgtgaacgatctccgatatgtagcctagggtcactagttcaaggccatcaggatgccacagttcagttgccctagccataatgccagaatgacgaatggatacttgtaataattaagccattctggccaaagacacgagcagaacgttgcagcaaagacatgtgggcctaaatcccagtcttaaaagttatgtcggcgttaaatggacctcatcattagaatttgacatggaatttatcttaatttgcttactacattatatggtttcgacacgaatcggagttaaggatgtagtgacatcccctcataagtcccctgacggtgcccataaactatctctaagtcactttaagtcacttagttaggcctttaacctctgctggcagatataacctaatatagctaatagttatatataccatcctaagctatactataaattgacgtagtcacagtactgtttgtacttttagaactggagctctacgagtggcggcccgatttccgtaaaggggtgttactacttaattacttgtagcgctaaacaatgattttgggactggaagtctagtggatatttgtggccccatcgtatttagggaatattaacgtaggcctgtcggaaattgagccaataacaagcaagtcaactttccgaagatgtgatccgtgcttttagttccaacaagaccctggtgatggcacacttgcaggtcagctgacgtagcatgtggnnnnnnnnnnnnnnnnnnnnnnnnnnnnnnnnnnnnnnnnnnnnnnnnnntaaattaatacgatcaaccacctcattggacgcaccaatgtattattagttctcagcagacaccatcttgtctcataagcactggattgagggtcagtatgagaacagcggtgggtcaaatcccactgccttcctaagattaaacagactgcttactacttatagccaccattggccataattcaactcaaactggaacaatcactcgtcattttcctacgtctattaccacacagagaccgaaaagacctctatctgtaacaagtatcatgccgaaatcactacaaatccgaggagcgggcaagattggcatcaaggatgtcgaaaaaccgtgtccagaagggaatcaagttcttgtaagtggattactatcataggattgaggctactcttcagatgtagtaattatccccctattgtttgaggcaagatatcttaccgtttcctcatctaggtgagagtggttgcttcgggacaggtgagaacggcgtatgcctccacgtctagagtccgctgataaggttccagaacccgctagacgttgcagtggtttggtaagacatactatgtatctggcctgaaccgaatgatgaggagatgctaatgaattatatagtattactgcgagcgtggcagagttcgtcgattattacaacgggaacactatagggtgtgactttgcgggtatagtagaagccgtaggtcctcagaccactcgattccagccaggagatagagtgggaggattcctcccgggcaatctacaagagcagggagcatttgcggaatatctggttgtagaagagtcattctctaccaggctccctgctagcatgctatttgaatatgcggctactatactaagagattattagtacttagtaataatctattttcttagattatagggattattataatatttaatttaagtggcttatatttcgttagtatgtcagcctccaagtattataatagtttaataattttatttagtatatatagactcttagtgacaaggctatcaattcttgctcataggttcagcttaacaacaaacattttaggaaatttgtattattagctagaacatatattattacataaccttgatcagtgtcatggcgttaaggctgactataattgaattcccagacactactatataaaccctctatagtaaaggtcgctgaaatacaagtagcctccggatctctctgttttaaaatttatacaagtaatatataatatttcatttaacttaaacttacttttataactacaatcacctgccttgaagaaatatatttggaaacagcttgcaagtaatattactattagtaagtgtaaagtattttctactcggaaggctattttgggaacctcggggggtgggcgtttctgattggctacaagatccgaggagtagcagatgcctccacatcttgatttacaatcttatgctggtttttaaggttacagcaatcttcacaagggtggtgtgggcccatcgcctgttccagttaatgtagctgagacgccatcactatttcaccagccagttccgagacctaactgaatctcattggttggcttcatattcacctcgcgaactgaatgtcattgatgacccgagagatgtcagcaaaggatccattgtctatgggattggaaaaaaagtgctcattttacggacatagccctaagtccatctttaagccggtacttttctaccccggacacgaatgtttgtaagaaagacattatctggaaacacaatggattaatttctctcagccccttctcgtgatatcttaaatccaacctcattcttatccccgatgtaaatttcgctcagggaacccactgatgtgcctaggtttgtatataaatattcggaaggagccctcatacatgcatcgagtatcttcagaacagccactcaccgatccttaatgtccgtaaagtccgaataaatattagataaactagacttgagtctcataaaattagactgaaatagacatattgtacacagctagaaaaagggagtatcgtaaattaaaatggacagaggaactgaaaggataaatccccatcaatatttatcaaccatgggacttctaagaaagttatttgattacaggtaaaatccactggactgtttctcttcgttatactgaccgttggtttccaggcgcaaagaacggcataggtttcgaatgcgctaagctcctctctaaaagctcttcatagtgccatattttactcggttaccggtctcgtgaaaagggaaaaaagctctagatgagttgcgcactggtaatccgttgagtgccatcagtctagttcagctggatgttacctccggtgcctcaattcattccgctgttttacacattgctgaaaatcacgggtgcttggatgttcttatcagtaatgcaggtattacttcaacggccgagcccctccttaaccagctgcatcagacattcgacacaaacactttcggacctgccgttcttatagcagcaatgacacctttgttgcagaagtctcaaggatctcggatcatatttgtttcttctgagcttggtagcattgagagaagaactgatcgaaactatatgtttgatgctatcgatgctttggcttactatatgagcaaagcagctctaaatatgcttgctatatgcttcgcgaaatcctccgaaaaaccctgcaaagatttggtgctatgaccctgggttttatgttacatacctcacgggtcctggagataggaagagctgagagaaactaggtgcaaggagtagtgaagtaggcgcacagagccttctaccgattatcgaagggcaaacagaatctgacgcagggaaattagtcaacgattctggtacactcttatagtagctatattactatgtattaacagatagattaatatatatagttattatatatatctatatagtggaattctaagtaatgttaaagtatacttattatataactataaaggcattatatccttccagaattaaaaagtttatatcttgactttacagtttggagcataaccagcttccgctctgttgtctttatatttattttcgagaagagggagtacctaaaaataccttagtgtacattctccactattttacagtatgggaatgtccatatatagcgaacaaatacataggtttctcaaagtagactaagtactgaggtgggaacaattgtgcctacagtgttagcgcaaaatcttgatacctttggtaagcgataaggtacaaccaccaatgaataggttgagttgccacgcaacgcagacaggctaattgattatataatccctccagcagtcatccaggaagacggattatacataaaccgaaaatgaaccttttagtcattcataagcttcgcgaaccaagtgcgtcacgtccattcgccttatcatttctgcctaatcgtctctcccccgcattaccaccgatatcatccttcgcgacaggacaatgtgctagaagctggcatcgcgtgtgcagctaaactaatagtatcggtaattttgatctcttcgatatggctcctacacgccctacttcgcggctcggattcgagattgctattatctgtgctctcactatcgaggcggacgctgtcgagtcactcttcgaccagcactggaatgacgagcaccccttcggcaaggcgtccggcgatcccaacgcatataccactggctctatcggtcgtcataatgtcgttctcgctcatatgcccggtatggggaaggcaaatgctgccgctgttgcagcacgttgccagaccagctatcccaacatcaaactagctcttgtcgtgggcatatgcggtgctgtaccctttatatcagatactgacaccgaaattatcctcggcgatatcatcataagcaacggcgttgttcaatatgacttcggacgtcgacttcccgaacgctttattcgcaaaaacacactacaagaatctttaggcaggcctaatttggagattcgcgccctactagggaagctagagggcaggcgcagtaggatgatgttgaacaagaagattatcagtcatcttggagagctacagaaagtatccaatttgcaagcgcattatcctggtccagactacgataagctgtttaatgcaaattttcgtcacctgatggatggaaagacatgtgaagaatgtggatgcaatggacaacttatatcccgccatcgattagaacaagaccatatacagccagcggttcactttggatgtatcgcttccggtgataccgtgatgaaatttggggaagagcgcgaccagattgcaaagcaggcgagcatcatcggctttgaaatggagagtgctggagtctgggatattttcccctctatagtgataaagggcgcctgcgactatgctgatagccacaaaaccaagaagtggcagcggtatgcagccgcaacagcagcagcttgtgcaaaagcattcttggagtattgggagccttcagctatagaccaagttgttgatgcaagtactgcaaaatgtacgtacacaggattgggtgcacaaaggggatacttactaattggactatagttactgtgccgtatcctagcaatccagactttattggacgctcagaaatcctacagcagcttagggagaccctaggccatatacagcagagagctgcatcctcttatttaagagcctcgctctttggcttgggcggcgttgggtacgttctttagtcttgtctatgacttttgaaaaaaaccgaggttgacaccaagtaggaaaacacagattgcgctggcccatgtatactggctgcaagagacgcaccctactctatccgtcttgtgggttcatgctagcaacgccgatcgcttccgtcagtcatatatgtcgattgcagaagagtaccagatccccggctatcatgatccaaaagtggatattagatattagaaaaatatatttattttttaatatctaaaagtattattataaaaaataataataacttataataataagtaaatataataattatagctttaatagtattataatctagaattataaaaaacttattataataaaaactaaaataaataatatagatcttagattagatatagaaataaaaatagctcttagatatatatctagtactaattaattagaaatagctaataagagaataataataaaaatataaaattaaatatagctaatagtaaaagaaaatagaaaaactatttctagaactatttaatattagaatctaagaatagagctaaataaataactaatagaaagtataatagaataagaaaaataatatctagtataaatatatataaataaaatatttagaagaagaaaaataactaaaaaatattctaaaaaaatatagaatctataataaactatttaaaaaaacttttaaaactagtctatctgaatatagctagtagaattataaaatctctattattaaaagaaaaaagctagttttttataaactttataattttataaaaccttagttataaatactctataaatatattaataatatattagtaaaaaactatatataattattaactttatttatagattactctataatatttatactaaaaaaaaaatagaaaactataacttattataaactactaatagcttaataagattatatataaagatagaatatccttactattaattatagaacttagagactagttatagagaaaatagtagtttattatactagattttaaaggagtttataatctaatataaattaaagagagagataaatagaaaatagtatttagcataaaattcagtctctataagtattttataataccttttaaactaataaatatatctataatattctaataaataattaattaaatactctaaaagtatcttaatatctttataattatttatcttaataatattttaattttcttaaataatttaaaaatatataaggaatatatatataaggttttagaaaaactagaagatataaaacttttagtaaaactagaaaaaaaactatttctatatataaaaagttaacttcttagaatatactatttaatttaataaaatataaataaaataagataaaattattataattaagaactagaaaatactaaaaactattaagaaagtataagcttttcttagatttactaactattattaataatttattaagaattataggaaaattattatatctctatataatattattaaaaaagaaatagaattctaatagaataataaataataagaagtatttaataaaattaagaattaaatacttttagaacctatattatagatatttaattctataaagaaagtagaacttaaaactaatactttagattttataattagtatataacttagctaaaagaataataatagagtattatactctatagtatttttcttaaagaaactatatagtatagaacttaattactctatctataataaagaatttatagctattatatatatatttannnnnnnnnnnnnnnnnnnnnnnnnnnnnnnnnnnnnnnnnnnnnnnnnntaaagaaactatatagtatagaacttaattactctatctataataaagaatttatagctattatatatatatttaaagagtttaaatactactacttaggaataatatataagattaagatatatataaattataagaatatttaatattttactataacttagtaacttaatagaagataaatttactatactaaatatttattctaatttaattataaaataatatattaaaaagagttagaaaatagaagaattaatactcttagctataaattagaatataaataaattatatctaagataaataaataattacttattataaataatagagaatacttagtatagaaagctttaggagctatacttaaggaaatagtatatactaagatctagataaatactattcctagtttagaaaaactataataggaaataagaataatacttattaaggaaatctataagtatctactcttagaatactaagaagttaaaaaaatatttaatagaattaaataatattataattatctagatttataaaaagaaatataaactatagttttannnnnnnnnnnnnnnnnnnnnnnnnnnnnnnnnnnnnnnnnnnnnnnnnnttaatattagaataactatagtaattaatatcttttaattatattattaaactattaaaatctaaagaactaataactaaagtaaaatataatagtattctaatagttattaataaatttataaagtataaatactttattctatataaagaaataaactctatagaagatcttatatattagtttctataatatatagttagctactataaactatctaataaaataatattagatagagaaataatatttatctctaagttttagtaattacttatagtataaatagatataaaatataagctcttaatagcttactatctataaagtaatagttaaatagaatatttaaactaaactctagaataatatctataagtatatattaactataaatagaataattagatataactattactaatagtataaattatatataatagttcagtataagaattaatctaactatctctaatatatattgttgaatttgagagattatagctactataagttagtggggtcagatcgctgctagcgatcctgaccactagcctctagcgattgcagccactggccacaatcgctaataaccccctgccaacgctagccaatagcgattgagatcgctatccgatagtgattacgatcactaaccaatagcggctgcagccactgtgggtcagtggctacagcccgctatgaccgctacggcttagcgggccctaggaaccctcaggggtccgggccaccagcagagctattattaggttatcaggcttatcaagcccagataagggtctagaaaatccgggaaaaatcctaggatattctcagacgatctaacctatacccaggctaccctgaggctgcgttggcgggaaggcttcgaggtttatctctaatagctgctccttttttatcggcacagcctgcttgcgtttgcgtgatgtgggaggcttttcaacttgcgcaagctcttgcgttattacgcgaaattcaacgaataatacaactcgtttctcctcgaataaccagctgtaggccgtatgttcattgaataatatgctgccgtcgaattgcttaggttctgaggcaatacaggtgaatgtgcccacctcagccctcggaggcttcacccagtttgtgccaaatcgtacgagcgtttgatcgaagccatcgagagagaagaaccggaaaatgtggctatcgaggagggtgtatccgtcgagttggtcggcatcgagccacgggatcatagggatatctatattatctaggaatcgttagctaggagccaaaggcagggaaagtgagacgaaactagtaatgtggtctttgtggccttgaagaagtgaagcctatcgtcgataaatccctccgaacaaagaggcttgacccgtaaccgtaggccaagcggactttgaagaagtgactcttccttagaggttcgtgtttgggctgtggcctctcttacgtgttggctcaaggcctcgagccgttcattgcgcgatgaagtcggcgttgacgatcttgacgatggtgatgacctgttgaaccgagagacaggtgtttgatgtgggatagttaatccaagccctgatgaagacgagcccctccgagaagaagaacccctctgagatgaagatgagcgattatttggctgccgccgcggagtcacgttagctgcttcaagatcgaaggcctctggccaaggcaggttgcagaaagggcaagaatccgaaaagttgaagcatttgcgaatctccgagtgcagcgccttcgtcgggtgcttcgagcagcggctagggatcgagttcattagatgagaatgaagaagaggctcgttaatcgtgatacggtgagaaacaaggagttgagtagccataacgctggaggaggtgcgttattttcgttgtattgtgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggtacaagagccggttgaaaatatagcaaaattgcagtaatgtgcagcttcatcgcgcggctgcgttgcgcagcatcacacgtgacgcccaagttgaagatacatcgcgacagatcaccacgacacgcgtgaatatcactgctgatgacactcctgaataactatactatttgtggcccaaaaaaattgtaagatatattattttaaagctctagatcttctctttctgcattttgaatctgttcttgaatatctcgaggaatggcatcaccagagaagttagagtctgtggtgtagttctgttgaagtaggcgctcgtattccttcgcaccacccctatgaattggcgtgagatctaacgccggctgcagcccttcttcgtcgtatgcctcaatgagatcacgcatcaataagaactccctaacaaatgggttttcaggattatcttgcaggtcaatacgagcatcaaatcctatctcttccagcctctcttggcaccacttcattgtgaattcgggcagaagagattccatatctgaatctgcgagaggctcgtacgtatcattgattagctgccaatccggagcctcctcatcatcgctcagaggaacaccccaattaggagcgtctgttgagtgatagaggtcctgagggatgccggatacaacgtgagggcgattcttctgatttcaaatacggtggccattccacagcgtcacaaactgggctaattcatcctgaattagaggaccatagatagcatacagggctatttggtctgccttgttatcctccctgaaaatcgcgtatccggccagttcgttgaagaatacgatccagcgatctgtagcgccctgccgaagctgccgccaccaggactcaattctgatattcctcttgctagggccatacatgtggcaactgcttaggcgatctccttgagagtaataatgttcaattccatcactatcgatgaatttgagcttcctaggcccaatcttcgcaagggtggcttgggctgctnnnnnnnnnnnnnnnnnnnnnnnnnnnnnnnnnnnnnnnnnnnnnnnnnncgatgaatttgagcttcctaggcccaatcttcgcaagggtggcttgggctgctgcccacaaaggggtctcggtgccgtggtcagagcgggtgaaaaaaggccgcatccgtaggtgcctaacggtctcaagaaactgcttcaatgtgctcatcgaggttgttgctgaccggccaatatagaaccaaattatacaccttgagtacgcgtcaatgcaagcatatatttgaaatccgaacttcttcaacttctcatagccgtcaagagaccacatgaagttaggccccggcacgcggaagttacggcgatatctgagttgcgcgtcacgccggccagcaacttcctcaggaacaatagctgaataggcagaataaagccggtgttgtgatatgagaaccttgccttgctgacgcacattggcacaaagaagccctcttccaagccctaggatcgcactggttttttttgaggtcatctcgaaggaattccaacgcgcgttggaggctgactagctgctcctcctttgcctcaagccgacgcgtcaggcgctcttggaagcggactttccggataagaaaaggatgtacaacaaagccttctctttggagatcacgaaggagggcttgatcagagtatcgaaagtgtaaaacagatacttcaggcgtttaacgagctcgtctgtagctactagagcgtggtgtcgtacatctaaatgccgctcttgaagctggctgtagaatgtacgtattgataccgttggaagacaccgttgctgaaggcagtcattgatatcagcgtgaatagcttcaattggatcaccttgaagatatcgctccgatatctcttcatagtaagaagttagatcagctcttaagcctgactggttaagcccaagtttgaccaggtgacgatcgagcgtgcggatcgcgattgggctaccaccgtcagcaacgatcaatttgtttagggaaaaaagtatctggtgcctggtccgatggagattgaattgatggaaaataaaactcgaatatcttgtaagatcattgcgttgtcgcatgttgaagataaggctctaattgcgatatgttgttatgagcgctttgcaggtaatgtgagggggctgtggggccgaaatggcaacttgcagtgttttttgctgcataccgccctattagtgactaccgtccaaatatttggtcacatgatctatgagtttcttggaaaacagatgatagaaatccgcccgtttatcaatcacatttaccgcctttacgattaagagcgacaacgccaaactcatttccaacatggctccctttcaagcttgtttcgacgattccaccgccaaatgcataatatcacagagccaagcacactgggagcgccttgccaaccttggtcgtcgttcttcccatgttggggtctcacctgctgatctcaaagagctccgaaaggccattaccgacaaaatgacgcgcatcgtcatgttcctgggtgctgctgccggcatgatgtacaatactttgggtttttcccactgcttatgtttcttgcggacattgcagctgtcgtgtatgactttcgatggttgcatggcccggtcaaggctgtggctggaaaattgaggagaaaatgcatacggtctggggcggtggcggatgagagcgtgcagatgcggattcagcagcagacggctgcaagtcagcctcgtgcaagcaccgccgcggaagatgcttcgctgaatcgccacaggactaggaggttgggacttggaaagtggaccgctgacatgggtgccgacttgagtaggcctctgccttaagccacccatgcgtactgggagaggaagatgtatacacttgtagcttgatttaacttagcttcactactacatacctaagttctaaagtattaatattggcgccctaatatgtcttgtagcgttagcgcatagctaaagttcttctgtcggtcttacataaggagagcaacttttatagcatacttgccaattgagggttcatgttgcgactgcatgaagattatgcacgttgatccgaggatcagatcatattgatattttagagtattttggccaagaataaaagggacaaaaatagtcaaatcgtggtatgtttagttcaagcaaatgatcttatcaaagccttcttccaaatgtcatattttgtctaagagagatagggaaagaaagatcttatgctgcgcttacctcaggtctggcatgtagttcataatcctacgattattcttagtcactacgatagaaatgaccataggaaaccggtgttcccaagtcttggcaattcaagacctgggacgaagtgaggacgaaggccaaggctgacatgccctaaaagagtcgtgtgataatcccttaagatcgttaataaggtctccaagctctgtcttcaacctcctgctctggtcgcctaaccgccgcatcagcatggtgcgcaccacaaagggctctttcgagagggttgagcgggtttacgcaacactgacgggggaccggctcaaaggagctgaggacgagatgcgagaaacacgagcgacgacggacgcagacgtggcgttcttgctccgtgagctgtccatctttggccatgcacagccgctctccaacgaaacgcggctgctcatgcgcagaaggatacaagcgattgacatctgggccagtacacccgcgatttggatcaccaccaaccccaacgacatcaacaacccggtcaagatgaggctcgggaagatacaacagggtcgccctcagtactatggatccagtcagctctgccatcttcttccacagggaaatttctctgttcttcgagaaatacgtcagaacgggccagcaatccgtctttgggaaggccagccattactatgcaacggtagacacgaacgatcgcggcagtctgcacttgcacgggctcctgttcattctccacctccagcaagcatatgcttcttttgcagggggtgtttagagaatgcaactcataccaggatagacctcaacttttcctttgactgagtgttgaaatgagcagtcatttttgcattagtaataccaagatggtgtctggctgtgcgtctgatcatcactctccaatacgatagaaatctaaatctataggaaggataggatttgtgatttgagagagcgcataaatgaccgtctaatctttcctctatattataccctcccgatgtgaaaaggctcaaataagacttgaaaatagaaaattagatgagaaggtcgataatccagtcgtaaatcttttcttgctctctgcctgctgaatctgcgaagtaccgagctatctgaaccaacggttgaggatccagaacatccaatcagaagaggttttgaaagagctcagcatctacgcattgctattctcggagtcgttccatggagctggggagaaaggcgccgtggatggtgtatttgcctgcgactgagtgttaccgtcagaagaacattgggcagcttccgatggctgatggtaatctgagcctgaatttcgcccagaggtgtacttgggtctaggtctcttcttaagcggtgggagaggcatattggagatcaaggatggcgtcctggttgctttcttagttagtcgtctgtccgccccccaaccttcagatcggatgccctgttctagtgtatgctgaatgagctacgtgcttcctaaattgaatcgatggtgctgggttgtcctttcaatatatattacaggctacgcgagtccgaccaatagcaacccaggcagcacaggtgggctagggggggctgtgaccatagcctgaggccactggctggtctgaaaatccgcctttccttgcactactagggggggttcaaaatcatctagccccatcccgacccccctccacttctcgaaggcgccaatccaaccgttggcggacttcattcgcgtctgggcgaggtcgcaacaccctcgacattttttttcctttcgattttgttaaagagagtggcgagattatatcgcgtggcgaaagtgggtgcgatgggaatgaaagttttgtcatccagctctgaaccgggcataagtgtacaagttatcgcgatcagccaatgaaagccaatgaaagtacgtatttggtgctattaaaaccatctttgaagctatccctctttaaaacaacattaactatggtttggcggattatggggattgtgccaatccccgcctcaggcacaacgatcgttgtgtcatcaggcgtcttaaaagagccgtcaatcatgacaaagtggagctcacttcacgggcctctgattctagcgaatccgtaggtcgtaacagcagttctgagctggaagcttatttgggtcaataacggacgtgcgcgagtggagtcaggcggataacaccgtcttgttcctcgtaaagactacccaataaacgtgttccctaccgatgtcggagaagttcaatgaaccgccgagactacactgtctagcttattgtaagcaaaggcagtggaatccacttacactgctagtatttatttaacatccgagacggttgaaccccccgagtagtgcgtgagcagcatctacggttcttgattggctcagaattacgagcatcggagggccgcacattggcgttagaggcgctagcttgatccaacggttgacccaatgagaagaaaagtaaaaaangaaaccacagtgttgtaattcttatgagcagattaggatcaaatcgcttagccatatagtagtctaataatgttagtcacaaccctcctagggagaatattctcactcaccggtattcttgatgcttaatgtcctaatgatgtgcaggctgcttgtagaacaggtgtgctgaaccttctccatgagagtttttctctcgtttgggctgtctggctgaagagagatatacaagacatcgccatggcaaataatctcagagaccagttggactgccttaggccacttgtagctcggccaagcaggttcgttcttgcgccgaaatctaaaccttttttctctttgtataaaataaatcaatgaaaatacatacatagcgagtctaaagtctaatggccttccggtctatgcaatcaccgccgcactggacccgtacgcattctgtggcccagtgtactcgacgggcttcgtatgctcaagcttgtctccatcctccgccttcttcccaaaccatgttccaaggtcctgctccagttgtgcgagcactttttcatcccacaattggaatggctcctttcccctggcaatctgccagatctgagccccggcagccataagactcaaggggaattcctcaccagcggtgaggggcttgagcgctccgccagcacgcccttccacaatgtcgctcgcaagtcgaggctcgcccgctgcaggtcgtccgaggccaatgccgtccacggagtcgagcgcactaaccatggggccgactgagcgcatgccgccagacaaatacagcttcatcttgcggtccgggcccagagcctgcgagatggcctaggcgaatttcagaaagaatccctctcgtatcttggtcgactctctctcgaacttcagacccaactcctcgtatgtaccaccactgagctctacaaaatcgaggccaagcttctcgagagtttcgcacacttcacgcgcctcgtcaggtgtgacgccaccttcttggaactccacgctgttcagtttggcggatacgatgaacttgggcgagactctggccttgacaccgcgcacgatatccgagaggaaccgcatgcggttctccgtggtctggacgccgtactcgtctgtgcgtttgttggtggtccgggagaggaactgagcgatgaggtatccgtgagccccgtgcagctcaattccgtcgaacccagccttttctaggtactcggccgcatatgcaaactcgtctacgatcttcttcatctcggctcgcgtggcagcgtggggcttgccaaaagtcatgccgtcctttggctctgtgttggtttgcagttaggactagccaaacaggcctgtgtgaagtgttgagcaaccacctaccaagttgaacggcagatgcggagacagacgtcgggctcaccgattctcggacctgtctccccggatgagtgatctgggcgacaatgagactgccatcggccttggctgccgtggcaagctctgtgaacttttcgaatcgctcgccctcgaagagacaatccggagtgatgatcatgtcgcctgggccattgaccatggctcagtttgtatcgatatttccggtaataatgccaccccaattattctttccttccccccatctgcaaaagacggatgaccattagtccggacaattaacaactcgcgcccggaaaaaaaggggtatcacgaaccttctgtacagttcaacaagctcatcggtaggaatacctcgctcatatacatgtttgggactccaagtagcgagaacctcggccatcgggcttttgagaaagcgattctttgcgatccgtccggatacagggaactcaaggttgcgtcccagaggcacagggctcacgtcgccagaactgtatcgtggaactgccattgtaaagactccggttttgctttgcaagatgagaatgaatttctagacaagattttctttaggacactatggtttggaaccgaaattttatctacttgctcctcctatttatcctcgacctttggcggggccattattcttcctcagctgtttatttgtaatacgcccaaacttcgattccatctgcttggaagcgcggtgccccgtggcgattgctgtgataagatttagacacttttttaagataaggaatgcaaatccaaatgccattgcaccaggcgatgcgaacaaggttagtctcagggattgcgtgagctccacggaggtgtccgtggagcgccacggagtcgaccatttgatcctttgcaacaagaaagcacactagtaccgtaacagccttggagagctatccaatgacaaatcccaccaatgttctaaattatcaaatcggattccttgatgttcgcgcttgtttgtttcgataaatgatctccttgaaaaaaccattccttgctttcaagtgcccgaggaaacgatagtttttctgtgggcacttcagtggatgtcggctccagtgataaggagatatcgaacgccagcagttcagtggaatgaattgctcgagccaatgcttcaataagctttccaagaaccaattggctctctttaccgcgtcaaatagaatttcccttgccacgtctcgtacaaagcgcaatttctccagagcatccttccaaagcggaacatctttcagatccagccaaacgggggtctgtagaggaattggataagctgtatcgagtacagataacctgtaacgagaatatacaagcttatgtattaccaaaaagcgccattaaatgggcagacgaggctggcctttgccagttcacactccaccaagaaagtctaggtcctattatgaggcaaataagagagacaatagcgcagagacaagaggcgcgggggatattactcctccctgccatagactttgagaagtgggattagctcacgatcaacaagtttacgctcgctgtattcattatttactgaagggaaatttccagagagggtgctactggatgaaagataggaagcggtagttataatcaactcttaatattctactgcctatttatctgatgcaattactcttcagcccagtaatgcttttattcaaagttaagcgcgaaacagtcatcctagtatatcttccgcaccgatggggatgttcgtatgagctaagagggaaagcagttgcgccctatcatcatattgatgtcattggtcatggtttgtcttagttctttgtccttatcaggaaatcgccttgaatatccgtctatgaacctcgccgctctcagtatgccttccagatcttgcttactcttaatagcgtataatgaaaagtcaaacaacgcaaagaagggcagagagttaagttgatccattccctccaagtatggtaccagtgcccagattatcatgcagagctctcgatattcttctaatatatgttgatcagctaacccatgaaagcggctcaggtcggctaagattagcagcatgatcaatctgatcgtaagtagcggtagatgggtgggatttgaggtgagactgttaaatgaaattgtaatgcgtcgtaaacgcgactcctcggaggctagctccgactgtaattgttggctgtctgatgaaggatgaccagaatagaatcctctcactttggaagcccacaccggccattggtcgaagatagccatgatgaagcttaggtcaaacatatctcgtgacccaacccctatgtcagtccagtacacctcatgtaagtgaataatcacgtcccgccatgtatcacggacaataaagccctgaatgtcgttcatagcccaatgtttttctggtctgatggcgggcctttctgcttgaggagctccccaagcgcccccatgtggacgccaaagtgatggcttcccggtccttgcatgaacagtgcctctgtccgttctagtaatgccatggctgccagcatctcaaccctaggtggagtgtaatctttgaccaaggggagtgtgttttgtatactgatcaatgccgtatcgtatagctcaaaggccgagaaatcgttgccgctaatgtagtcagaccacgcagagcaaaacaattctgtgcaggcatccagagaaatgtgccgggacaaacgctcaggaaggtgatagaggtatctcatctcatagtgattctgtggcctcgatcttgcttaagtaggtttttcaggcggtccgagagtgaattgctagctaaaggttggcctgcgatattgagcttggagtgtggttcaagaatttgactaatgacgacggccctggacaggagcgttgacctttcctacatggaccacacgttggcctcgcttggtcgcactgggatattaattagcaagctgccagccagccaggatcagaagagtccatagcctgcttctccgggccttgcaaggcgcgcacgcctttgacctagggattccgggcatttctttacaagtttttgggagaattttcttttcttttggaatttaggtggtggcgggtgtaaccagttctttcgtccttggtggaagactaattataggcttacagaccgctggaaccggggtctcagaaaccaacggtccaaaagggtgagtcggcaccgcaaggatctgaataaaaatagcttctatttacatacatatgattgttgaaatagtaaggtttaatatcagaaactgatgacaaatgaacttgctggttacacagagtggtaggggaagcgtcaataacagtcttgcccctggatggatcctaaaacttggaccaatcacaaaacttggaccaatcacaaaacttggaccaataccaaaacttggaccgataccaaaaattggatggaccctcaaacttggactgatccgtccattcaatttgtactgtaacctatacgatagtctaatcattgcttcaatcgcatacccaagctagactggatagagtccctgtttttatggcttatggtacgacttgtctccggcttcctctgttgtaatacaataaaacccaacacgcagtagccacgatcatagcacatgaagcagtccagcttataggcaggaatttacttcctctctcggcgaaaataccaattccttcccccactgtacaatacaatacaatttattgcgcccggcggcttattttggccgatagggcactagtcactaattcgtacgtacattgcctagttgtcgtcctcgcctccccaagcccatgctgtgctacacgttgctcaatctgtgtccgcattccctaaagcccagactataccttgcttttcaccatatgaattgaaataggtctcctcgagcccataatgcgcctgttcctcgattgtgcttttccatctaccctattgctccctgcggtttccagtgatgtactagcatagccagcgaactagcttgaaggctattcttcaagtgtgcaacgtcctatcttcggcggctgaagcgacgttcgcttttatgagacggggtgtttggtgtttaatataagtaggnnnnnnnnnnnnnnnnnnnnnnnnnnnnnnnnnnnnnnnnnnnnnnnnnnggaagagtaagtaggtgagattcttgcaatctggtttcagtattgtgtgtcgagtcggcctgtggccattgcaaatcgtgtagttgcatggactgcctgcatgtttggcgtccactttgcgtcatctttatggtgattttcctcctagacagaacgagaggtttcctctcaatgtctccgtgcactgcaacatttcagtcctatgcgctgtccatttcgtgcatcgaaagagaaagtgctctactgtctatatcgcttgcccgcatacgcattgctgtgaaactgctactctgatccggaagaggtacccgttcagtctggccatgcgtgtcctaagctgtgatagcacgctggcttctctccgtgataagccatcatagagcagtcgggtgtgcttgcctgggagtgcagcatcgaccttctttgaaaacctcccgacgttatctggtagctgtttcctagtacgctcacctgattgagctatgttcaaggtcgtcgatcgcattctgggaaacttccgggccgggacgacaccttctcggcttgcagctcgcgcttctttcttagccatcttcaagagcctgtgttcagcactggtgggtatccatacgacagccactacattccgcttgacctgcaacgagttaatagaatcatatatgcatccaacatattcttggccggactgctggcgagggtttcggatcgtaagcacggcggctttgttgctcgccaatagtgccacacttcggtactcgaggtcgggcaagtgtctcaatgcatatgccatcgccgccagctccccagagaacgggttctgctccgttctcatgccgagcgtgaaggagaaaacagtcgtgctgaggaagcaaggcaaggacaactacgccaatcccggatcataccggccaataggattattaaatactataggcaagatcatggatgccatcatcgcgacccgtttaagctacgtggctgagacacacaacctgctccctccaacccatgtgggaggccgcaagctgagatcaaccgaacatgcaatacatcacatcatcgataaagtttacgaagcgtggaacaggggcagaggtcaggtagctagtcttctactgcttgatgtctcgggagccttcgataatgtctcgcacaagcggcttctccacaacctacggaagaggagaattgacgagaagacagtcaggtggatatcgagtctccttgaggaccggaacaccaggatatcgatcgacggattcatgacagaacgacatagcgtctccacaggaacagtacaaggctctccactctcaccgattctctacactttctataatgcagatcttattgaaagctgcagcctggcagaagataccacagccactgggtttatcgacgacgtggctatcctcacatggggagatacgacgacggaaacatatagcaagcttcagcaggtactccgactggcagagcagtgggcgaaaagtcatgcatcggtcttctcgccaagtaagttccagcttatacattttaccagggcgcgcacgagaatagacaaggaacggcctctgcaaacagcgtggggcgagattcccgcaaagccgacctgcaaatatctggggctcactatggatgatacgctacgatggaagccccatgtggatgaaatacagagaaaggcaacaaagacaatttcggccctcagtagtctcggtaactcggcttggggactcactctccgagacatgaggaagatctaccgaggagtggttataccccagatcatgtacgcatgctccgcgtggtccaacgccaactggagaacacaaaacatgccatacaccactaaaacgctggagggactgcaacgcctgcaagcacgagcggccagagtgataaccggtgctttcaaagccacatcagctcctgccttggatatcgaaacctatctcctatcggtcaaataccagatatggaaacacaacgccgactgcctagggagaatcggcttcggggggtcagagccggggtatggcgtagatggcccagaagaacgaaagacgagaatgagcccgcgaaaagcgatacagaaggctatacgggaggagcaaggattcaatctggaacaaatagaagcaattcctccacacgtcgtcccgccatggtggacgggcccaaggacatttatcgaagagaatgccgagaaggcacaagcgaggcaccagtacaacactgtaaacgagttaaacgctctgcatatatacacggacggaagcgccatcaacggccatgtgggagcggtagcagtatgtaccgctatcgataaaactagaagtgcttacatgggcaaggataccacatcgacagtgtatgctgcagagctacagggtatttctctggctctccagatcgctcaggagaacagaaacaggggcaatgttaggaagaaaatactgatctacacagataaccaggcagctatcaggtcggtggcaaggcccagaggccagtcaggggcatacatactccagattataacacaacaactgcaggaactgcaaatacaaggccttgccgtngagatccgatggatcccagcccacaaggggatagatggcaatgaactggctgattgcgcggctaaagaagccacgggatggcgacgtagaggacagccgggaccaagagcgccaaagccgccgatatcatattcactgaaatccacgttgaaaatgtggtcgcgcagagttgtcaatgaaagatggcgagcacagtggcagcaggaaatcaggggccgggcaacgttccnnnnnnnnnnnnnnnnnnnnnnnnnnnnnnnnnnnnnnnnnnnnnnnnnnggatggcgacgtagaggacagccgggaccaagagcgccaaagccgccgatattatattcactgaaatccacgttgaaaatgtggtcgcgcagagttgtcaatgaaagatggcgaacacagtggcagggggaaatcaggggccgggcaacgttccgtcacacccccgagccgacacctaaggtgctgcagctacacgagcacttcagcaaaaggcagagcgccatatacatccagctccggacagagaagatagggatgagggacttcctcttcaagcgaagagtgccggggattgctgaccccagatgtgactgcggcgagggacgacagacagtagcgcacatcctacttcaatgcagaaagtacactgcaatccgaaaacaggagataggaagattccagcgacttcaggacctccgggcgttattgacggagagcaaagtagcagcaaaggtcgtcaagtttatggaacgaacccagatccttgggcagttcaggatcagtccataaccagacaaagctaagcactggggggagactgtaggtagggaggacgcagatacgaggcggagggtctgcctcactagaagtcgaactcatatgtacgttagaatattgaaccaccatctacggaagccagcaggccgaggtagatagaggttgagaggaaaagtgggaagtttggaggcagctggtcaacaccgaaacggggttggcgaagtggggcgccacggataaatattcggggcgcttcggcggtcggccaaaccccgctagccgggcatggctgctgttaagtagcggctaaaaccgagtaggaatacaaccaaccaaccaaccaaccaaatgcctggggcttctcgtggaggtcatccgccgcttgtcctattgggtcaatggggcgtgcatcagcacagctggtcgctgcctgtagagaccggctgagtgatatatcaatctagatgcagcgacacacaactacaatattaatttccatccatttatttgttgtactatgcagctcatgttgtggcggtgttccaggtgttgctttcacaggagaccgtcccctacggcccctacgggtccctgcgggttccgctaatgccttttcggaacgagttgagagcttgagaagtgggagctgaggaccagagtggaaatatagtcttggaataagtagcaacacaaggccccgcaggggtcttttacagaggctatcacagtgtattagtgttaataacacagtacgtcacataagtccttagccttaatagaaagaaagataaaagaatctattaataatagactaattagtagatcttaggcagttagcccctcctctgaatgctaagacagtactaatatgttttcacaagttaaggtttgtgagaaacgcctcttccgttctagaccaactggttttgggtggcgttttctgatgccatccactagctactcgaaattgtctgccatccactagctactcgaaattgtctgacgcctcactaaaccctttccccttcccttccacattgcacatccacacctggtggcatgcatgtttgtaatcctcccagctgtaatgattttcgagacctggactcgcttgagattcaatggcatgacttgtggatgtcggcgatgatttcgtgtcagcaggaacctgtatggacaccttgtgagaatgatattgcttgatttgggctttttggtctggcacgcaaacctggggagaggcgcattgtcctggagcttcggaaccggatgcgatcgggtggttgaaggcagactccccgatttagtgcgtaaaagctagcctcgcgaggcagttctaatcgagagaaggcgtcctggtggcaaagaagtcggagccagagcccaagctccggagagtaagggtccatccgttataaaccccttgataatcaagcgaacgagggtgaagatatttccccagtctagtgtccaaaagcaaagtaatgacggaagagaattgcactgaggtgatagtttcgcagctagaacatctaagagcattgcaagaattataggtagccctggaaatagtcctgtcgcgggggcaggtccgttgaagtagagatctggcaagctactgtttacttcgttgggaaatgtggcgccattaattgagtcacaactacggatacacttgctttttggagttggaaggcaaaggatggcagatcgaagattggtctagaaggcatcctgagcaaggaaagtgtgcgcctagggcctctaagtttagcttatgttgcttagtgctctgagtgtgaaggagggggtctggaattgatccattgccctctagtcaactgatcgacgggagtaggagaggaaggggtactactttaaccgatttagctggcaatggctacatgacaaacgctgttggggcttgtgttgtctctcgccgtacaccttatgtctgtagtccaaactagctagtcggtatagggaaagccatcaggccgtttagacgcggccttggctggctaaaacttaaatcaaccccacgataacggtcaaacaccatcagggtgtagtggcaccaaacgctctccatagcttatatcgagatccttcaagccattcgctaacgcaaacctcggattggaaagaatcccgggagattggatagtgacgctaagctcgctaacctcctcgcatattaagggcttatgctttagaaaccggtagatggtggtggagtgcatctgcggtattccgacagctagcagatggtggtggttttccgcggaccagcgaatacttggccgactgacccattcgctcttcttttgcgtaccaaagttaaaaggttttttttttcagagcatgcacgtttttgctttttacaagataaaagagtggccattgggcaacagtagcaaggctatatcgacccattatcccttcctctcactgtgcctatcaactgggaggagaaattataccgcgccataatttgctctctgtctctatcttccgtctgccatttaccacgcgtcgatactaatcggtgattcccccagctatgaggtagtcaggccctccatgcccgccgacgatcctggctcgagcgccctgtcgtcgagcaatttcaagaacaccgtcgtcgtcgtctcatttgtctctgttgccttctacaatattcttgagctcaccttcatagtgtttgccaccttcaagaagcgaagtggcctgtacttttggagtttttgcgttgccatttggggtatcctgccctattcgatcgccttcctcctcaaggcccttgggacgaacccaggtgctacccacgtgtatattaccctcatcgtcatcggctggtgttgcactgtcaccggccagtctgtcgtcctttactctcgccttcatctcgtcgactggaataagcgccacccccgtttcgtactcgcaatgataatcactaatggcgtcgtcctccattccgtaaccaccgtcatggtatttggcgccaactcatctacttattcaggcctcttcgtgaagccctactcaatcgtcgagaagatcaaggttaccatcttctccgtccaggagctcaccatctcctcgctctatattcttgctacgctcaagctattccgtcactccgtcatccacgcgagatcgaaccgtacccacatcctccggcatcttattttcgtcaacatcatcgtcatcttccttgatattaccattcttagtcttgaatatgccaatctctaccagttccaaaccgcctacaagggcatggcctactctatcaagctcaagctcgagtttaatattctcaacgagcttgtcaacctcactacatcccgttccggtttcggcgtgagcgatccaaatgactatatcttcgacgggactcagcgcagtaacacgcgcaggaaattctcgcgccagtcgacggtgcttcccacggcgctttcgtgtgcacatactggagacctttcagtgacggcacgggatacacggacgggagaagggagtgcaatagaggtcaagacggcgagcgctgcttatgtatccgatgagtgggggaatcggtatccgcgtaacgacggcatcatagtcacgcggacggtcgaggtggatgtcgactgtgagccagagttgggaagcccaggagcaaagtgacgacggaggctttcagtctcaattggccactgttagctcgacccatcaacgaacaaagtgcggataacctacataagggttaatggcctctgtctagagggcctttggcccctttgacactctcgactacccaccaattgactctttgaagagatgcggtacaaattcgatgaagttgtggggagtacagagacccgtgaccgaatcgtggtcgctccacccatgaatgggatagcatttggcaccatattgaccaatgcagtcttttacattatcccttgggttcgagtatcctctgatagagaagcgacccccaagctgacactcgactagggcattataagaatctccattcgcggacaaattttccgacggggatgacctgccatcccaagtggagatctggaatcgtgatcccccaagtgagacttaaacagaccacttcttggtggtgttctcatactttgtcaataataggatgacctcttcaccttgactggaaatatctgcccgtttgtcgagaagaagcttgactatgtcgagatgcccctctcttgctgcacaatgaatcggcatccgcggtttgctaagaggacaggcacttgggacgaagcagatcctagaggtaactagctgaccacagaaagctagcctacttgaatagctaattgcaggaaaagaaaagttcgagacatgctggtcaattaaccctggtagagggtgcaagatgtgggattactgaagacattggaacattggaatacatgcgttatgttcttcgcttcagaacgaggttgttnagttatagcgaacttccctgctgcgttatagcggtctcaaggcctaatacaccttgaaggccactgtaatttcaacacttcttcttctaagtatcttacctatatatatttataccaggtattactttccttattctattatactttctattaattatttatttagctctattcttagattctaatattaaatagttctaggggtagtttttctatttccttttactattagctatacttaactttatattcttattattattctcttattagctgtttctaattaattagtactaagtatatatctaagggttattcttatttctatatttaacctaagatttatattatttatcttagttcttattataataagtttcttatagttctagattatagtactattaaggctataactattatatctacttattattataagttattattattttttatagtagtacttttagatattaaaaaataaatatatttttctaatatctaataaaattttaatttctattaatcctgatttagatatttagaagagtactactactctatatagctagtatactagttaattagtaggtttatatcctgtaactatagtagccctaatataatattatagccttctagtagtactaagttatatataatattaaatttctttccttagattttagttataagataattagtctctaagttaataattctattattatacttaaattttaagccttctatattagctnnnnnnnnnnnnnnnnnnnnnnnnnnnnnnnnnnnnnnnnnnnnnnnnnnnnnnnnnnnctatttctataaggatatatatagagcttctagcttctattactcctagggtcctctaacctattattaatattatactatactatagccctattatagatagtttaggttattttttacctagttaacttattcctttagttacttatactaatttatatttattagtatatagaaaagaagttcttctaagatatttagttatattatacccttagataagtactattaaaacttctttatttattccttaattttatttatttatattagtatagttagttctttatatactatactctattcttttttattagtaaaggttattcctaattcctccgagttactactatctctattattagttagagaaggtactctttctttatatatatattatagttcttcctcctaatactagtattattagaggtatagtttagtagtatttatattattattactatatattactaattctagtatttcctacttaacttccttatagtttctatatctctagttattatattatttaatctagctattatatatatatattacttaatcttctatatacttctgattatactatagtttaagttttttatccttataaaccttatactataattccctatatatttctactaatagttctttatatatatatttaatagggtattcttctagatcttccttaaagatagtatatagtcctattccgtattattaatatataaagtatattatttaaatatttttaagtttaataggtattttcctattagggtatagaaaaaagttattttttattttagccttctaatatatctagtactaaatattataataggttaacataatccacaagtgagccgatcatacaagtgggccgatcacttttatctagaaattagaacttcctctttacaacataataattttctaacctaaaatgaagaatacttcgtataaagcaagtattatccttataattcaagctcttaattaagactctaaattaagcattagagccgcagcaaagatctatcaagtcctatatactaccctttataaccgacgcgctggtcgtacggcaagacgcgatactcgatctaaatcaatgaatcttacaaaagaagaggaggatgttattgtctcgtacgtcattgagctatctacacgtgcgtttcctcctaggatacgtagtgttgaggaaatagccaatatcctcctacgcgtacgcgacacgccccctgttggagttaattgggcctccaacttcatcaagcggcaaccagagcttcatacgcgctgggttcggaaatatgactatcagagggctaaatacgaagatccaaaggttatcggaccttggtttactctcatatacaacctgaaggcaaaatacagcatcctagataaggacctatacaactttaacgagaccggctttataatgggggttatcttccctggaatagtggttactacctcagagggtcgtacgaaggctaagctagtccagcctggtaaccgggagtaagcaactgtaatccaaggggtaaatacagctagctgggctatccctcctttcatcatcctagctacccaatattatcttgagaattagtatcaggaatacaacctgctgtatgattagtagctaacaacaactgagaatagctggactactaataaggttagtctagattggattaagtactttgattcctatacagctcctcgtacgaagggggtatatcgaatgctaatccttgatagctataagagctaccactcagctgactttgagacttattattaagagtataagattattacagtctgtatacctccttactcctcttaccttcttcagctattagatgttagctgctttagaccactaaagcagttgtacggaagagagattgagaagttaatacggatgtatattacccatattagtaagcttgagtttctctcttcctttcgtacggctttcttctactcctttacgaagaagaatatccaggcaggctttattggatccggcctaataccgtacgacccagagagggttctttcaaagctagatgtggtgctgcgaacgctaataccaccagagaccctacctgagataaggcagccctgggttctaaagacgctacagactgtgtacgaggcaagcgcacagtctgagcatattaaatcccgaatctcagcttataaaaatagctctccaacctctatgctggctgcaatggatcaatttacaaagggggcaactgcagtaatacaccaggtggctcttttgcgtgctgaggtccgggatcttcgtacggcaaataaggcactaagcaagcgccgaagagctagaaaaagccgtgtacggcttggaggatccctaactatacaggatggaatagatctattggaccagaaggatgtggatgagcagctaagaggggaaaaccgcagaagtggtagccagggagggcaggctcgtacgaagactccacgatgtggcaactgcggaaagcctggtcataatatccgaacctgtagggaggctggagaggaatctgataaattaatttctagtattattatggtagataattagttgttattattttaattgagtttattgtacgagggataggtagaagtgatcggcccacttgtatgatcggcttacttgtggattatgttatctataattcagtagaatattttaatattcctatagtttttatataagttagtatattatatctattaccttagtatcagatagtattaatagtatttttcctatagactattagttctaagtctctttccagattctgctcttatattttcttttaataataggtatatagtttattatattcagctttaattttacttctagtaaatatatactattcctattctttacttatcttctagataaggttattagtataatagaatatatacttatacctagtaagaggcctgtattttagaatattttctccttacttatatttttatttaaggttctaaaagatttataagatttactattacctttcttataatatactctagtcctagtattatcctagttttaatattttaataaaggtagtagtagatattctggaaaatataggaactatagtagttatagagtttatttcctaagcagtccttctaactattctaagagttttaattttagtttttttagttacttttagctattttttactttctttagcaggtttctaattcttctgctttcttagctttatatattatagtaagatatatctaattttattatagttataatatttatatttttctatagctcctagctctatagaacctatatatattctagagattatagtttattattattatagtttactagtattagtatagtaatttatttactatttatatatttactactagtattattaattattaattcttataactatagttataaaattataaatacttactagtctatcttccttatagagttcttcctagacttttttcttaagttagttaaaatagtaagatatagtatatttataatcctagctagttctagctaaaagctgaaggtatttagtactaaagactaatactaatccagtctaagtaaatagattaatcttatactctatcttatatttcttatcttatattctaaaggtttagtaaaggacttctataaagtaattaaagtttattataatacttatagtttactaacttctatatctactaaggtattcccttataatagatttaaactagttaagagtacttcctttaagttataagtaggtatatataacttacctcttattagtattaagagtaatagggaaatagttaaagtatacttatagttaaattataaatccctaaagtttagcctatattctattaaatatctcaggtactaatagcttaagtagtattcctagctcttacttattagctacagcctgggcctaagcttgcaggttagtattctgagcagcttactatcctatcagattagttatagttactatctcctactatatagttataagatattcctaaagttagagaacttactccctaaggagtttaacttcagtattattattactactactgctactattactattatccttatctattatattattatatagaacaggtagattattagcagtagtaggagtatagtactactaagcttataaaactgtagtagctataatatcttctttattattatatagtaattaagataaggtaattagctgaataagagttattaatatataatagttaggtaacttatactagatagggatctagaataagttagaattaaactaattagatattattctaagtagtataatcaggttattataggctgtataatataagttactattaatatataagtattataaagctagtaataatagatatatagataattatattaataactatctgaaagagtatttctatctagtaaaataaatatatatatatacttagggacttataatagcttactggtaatccagagtaagtttagctgaggattattcaggcttactgataatccggagtaatctatcccttactagtagaaaagatagagtatattatataatatagtagtatatactttgtttgtaataatatttatataataatagagctatttatatacttatctaactatctatttataatatactaatagtataagattagctatattataaataagattaacttatatttaaagtaatactataactatattaagattagtaagtaaagaataatttaataaattattaggaatatctctagtttactaaagaactaggaagaactaaagagtttctagttattattattaataatagagctaatactatttatagtactatctgaaaagaataataaataatataataaatatctattaaaagctctatatatagtttaaaagcagactagtatataaagatattatatagaagtttattaatagattagtaattagaagagagaaaagaatataaagtagaaagctttatagctatagttacttctatagatatctagtatttactattagtacttcttctatagatagattataaatagatagtttaaagttagttataataagactaagctatttattattacttatactaaagatctaattatatagtttaaaaaagtatataaaatataaaagtaatactttaaattaaatagctaaatagctattaaaatagctagtaatagattagagttaaataactaattagactttataggctagatatagtatctagaaggcttataactagatactctatagaagatattaaaactaactaaagaaggtaaaactatactatagtaggtattagggattctaaagtaaattatagattaggcttaagctatagtaatactaaggaaagtaggaaaattaatactttttaagatttagtaaaaaaaaatatacttaaaactaaaatagctatttaataactaactagagaataatatatagatataatataaaaatatattttataagataatatatatattataatagtttaagaactagaataataactaatagttactatattaattattagtttaataagaagattaatagaattatttctataaagctattaagaaatagaatattaatagtttaataataataaaatagaaagtactagagtaaatatatctagatatagttattagatagttagattatctattaaagtagaactattataataatattataattagctatttagtagttataggaatatagaaagatagtagataagaagatatagttaactatatatctatttacttagctataattaagatagtatagatactaataatctactaaatatatttagaataaaaagataaaataattatactaataactactataaataagtagagatagataaagatagataagaataagatatataataaggtatagagtatatttagagttatatagaataaaatagagtaatttataatatagataactaataagctagaaatagagctaatattaataaactggatctttaagatatatatatatagaatatatatctataagaaagtaattccgtatagaaggacttctacttttagcaagctgtacttcacagcctgttatcaggtatctctacattggatagttcaccgctttccctttatatcgccttcctataccgccttctatttttactactctgcctctttcctaatttatctgagctcttcaccacctacctgattaggcagagtcccaaaagttatccaaagctcaccgcctaccagatttagttataagctgtcccaaatcttagctctcctaaaacttatctactatcccagatcctatcctctaacggtataaccaaccgttttgttttatagaaatagatatcgaatggtaatttttcctatgtaatatacccctgtctataggtattaaaatatagttttatttatatacacctcttgaccagttcccagactaggagctatagctattactcctatatctccccttcttattaattactctcgttgctctctgtttatatttatatattttacagttaagtagatatatatatttattcacttctaatatattcctacttatcgggttaatatttaccttaaaaaattatacctcgactattaaagcttccaagatatatacagcagtaatacaatattggctgtaatagtataggggatactgcttaatccggcgtaaactatagcctatatataaagaggtataaggaatatccttaaacagctcagatttctaataattcttataacttaggctctaagctagattaatataagaacagcttaggcagggataatagtaaccttgttcgaatactattaattccaactgataatagctcccgataaaactctggaaaatcgaagagggacctaattagcttaaccgaactatctggtttaaatactgatactgaagaagggtctaacgattgctcggatataagctctgattcagagtctgacttagaaagccttattaactctagctacagctcagctgaggataatttagaaaataaagcttgtttctataaatccttcgaggctaaatataagatagaaggtctaataatatctgtttataaagataatataaagaaaataactgaactagaggaaatacaatagaataggtatatctgatagttgttcttcagaagatatactaatagactgtaattcaggtattatattatttgtaagtataaccctgataaatctataaaggcctgtaatactttatttattaaatcctgatattaatacaacgacgggctgtagtagagattatagaaaacctcacctgattaaaatcacactaatgaagacagggggtagagattatagaagattaaggggtagaaatcatagaaaatattatattttgattagatattagagtaagagacctactttataacagggaagcgagtatagtatactaggcaggttaataaagagaataggagttataaggaggaggaaaaagagattatagctagtaaaagcactatctatacaatgtatctatataatatatctatataataatagagctatttgtacacttgcccaactacccgtttgtaatataccgatagtataaggttagctgtattacggacgagattaactcgcacttgagatagtactacagctatattaaggccagcgagcgaaggataattcaataaattatcagggatatctctagcttactgaagaaccaggaagagctgaagagcttccagctactactactaacaacagagctaatactatttatagctccgcccgaaaaggacggtaaataatacaacgagtgcccattagtagccctatatatagtccgaacgcaggccggtatataaagatattatatagaagtccatcaataggtcagcgattggaagagaggagggaatataaggcagaaggcttcacagctacagttacttccgtggacatctggcgttcgctgtcagcgcttcttccgcgggcgggctgcgagtaggtagtttaaagtcggttgtgataagaccgagctacttattattacccacgctgaagacccgattacgcggttcaaaaaagcacataaggtacaggagcagcacttcaagtcgagcagccaaatggctatcaaggtagccagcgataggttggagtcgaacggctggttggactttattagctgggcgcagtatctagaaggcttgcgaccggatactctacgggaggtgctgaaaccagccgaagaaggtgaaactgcgctgcagcgggtgttgggggttctggagcaggttatagatcaggctcgggctacagtaacaccgaggaaagcagggaaactagcgctttttaagattcagcgaaaggagatatacttaaaaccgaagcggctatttaataactagctagaggataatatataggtacagtataaggatatgttccgcaagataatatatatattatagcggtttgaggactgggataataactaacagctactatatcgattattagttcggcagggagatcaataggaccacttccgcaaggctattaagaaacaggatactaacagctcagcaatagtaaagcaggaggtactagagcggatatatctggatacagttatcaggtagctagattacccgttaaagcaggactactataataatatcataatcagctatctaacagttatagggatataggaagatagtaggtaggaggatatagttaactatatacctgtctactcagctgtaattaaggtagtacagatactggtagtctattaagtatacttagagtaggaagacaaggtagctgtactaatagctgctacagacgagcggggacaggtaaagatagataaggataaggtatataataaggtatagagcatattcagggtcatacggggcaaggtggagcgatttataatacggacgactggcaggccagaggcagagctgatactgatagactggatcttcgaggtatatatatacgggatatacatccgattcaatacagtagcgggaggtagtatcaactgggatagcgaacgcgtatcgtataagcagatcaagttcagtataggccagctgacagagatactgtatcagcttgtgcaggagtccagggagcttctggaagagctggcgatagtggagacagaagggcttagggtagtaccagggatcgagtagtccaagatggaggataactacagcgaggaccgggtcggctacttgttcttagaggataactgtaacgagtagctgggtaagggccgtagataggttctaaaccggattattaagtcccggaagaggaggataaggtagatctctatcaggggtaataacagggccccgtataaggccgacgcagttcgcatatacgggcgaaagctggagcagtttcggaagaggatgttcttactgatatatataatattaataccagtacggatactggagatctcagggattcagttctataacatggtaaatagtagtataaggaacgtgttcacatacaaccggataatatactttataatattatactataagaacttccggaggacggagcagagtaagattatttattaatacttaccccgagaggtgggagagcttctggtgtggtacttgtagctggtgctgctgttctagcagcaggtacagggtatcttgaaaggagcggacgagcacagtatatttctatgggcagataagattatcaagccgagggagggcaaggagagagataaagagagggagaggaggagcaaggagagggaagataggaagggcgaggtggatggcgagggatcagaggcggaggtagagggttttaagcactagctggataagcgtaagtggacatcggaccgagtacggaggatcatacagcagcagagcgagcggctgcttaaggcgcggctgaatattagtttgtggaggtatatcatgatcgcgatcgcaaactgatatctcaaacagttattcgggcaggatgagacaggcggcgagggcgataaggaggagggagataatctcgatgataatgctctggatctgcaatcagggcacgggatacatatagccggaatagtatacatacgagagctgcagcagggccagttcggaacagcgcagcggcgggatcagtttcagttagtaagctgacagtggtaccaattcttcgacttgggcgcggaggaccgggcaggggtagggctagcgaagtagggccaggagccgttcgatacagtacgagaggaggcaaggttccagcggttcagacggctgcagcaggtggatatacacagacagctacggatactgctggggcccggagcggacttctatagcaggcagcaggcggtgatatgattgattgtgcgtagggagagcccgatagtacagatcactagtacggggggcggtaagagcttatcattcatactactggtattctgctcagcgggtagtacgacgatcataatcgtgctgctagtattactgcgggaggatatacacgggcggtataaggatagcgggatcgagttgtatatatagcagagctagcaaggcaaccgggtggcaacatgtaagagcctcgagccttgaccaggcttatcctcggagctacgggtcaaggccggctaaaggcatcccttcggccacataaagcatttccaacccacacatagcctacttggaagcttcaagctttagtactcaattgaattgcaaggcagccttattttcctctacctgactatcataccctatagtgagactataataattctaaagcttctacccctagttacctagaggaagatggctcccgcctttgtaacccgaagcacctcaacgcatgcccctgaaaatctcgcacccgaagacctccttgaggagataattgaggagcaagagcgaggaagtcgcaacaactcaaacaaaaggaataagaccctaaacaccgatcgagatacacccgatacctccactgaacctggagctaagagggatatacctgccgagaccctcagcgcaatagaagcccgtatcgcggaccttattgaataagagagaaccattcaatatatcaaggaagcccaggctcgagagagggagctacagcaatcccttacaaagctctgaggggaaatcacgaacacaccctcgaagcccaggtaaaactcatccggcagtaataacagccgagacctaccgctccctgaagttaaacccctgaggtcgacacctacactcagacgaagggataagtagctgagcgatctcgaactcgcctacgaaggggccccgaagaagtttaaagcggaaaagaaaagggttctctttacagtctaatgcttggaccccgaaccccgagcgatgtggcacatacacctacgcgatatacccgcgaaagatcaagaggcaaataagacggatctaggctacttccaacattggaccctcaccctaatcaaggatacagctaaccgcgaggctataatagcggataaattcgaggaggtaaagcagcaagaaaatcagtctcctcaggagttccacacctatctcagctccttagaacagcattttgaacatacctctgaggtacacagagccttaatcttcttttccaagctagataaaggcctcaaggaccggatcaagggttcaggaaagaatatcccctcaacccgagacaaggtcgtaactctcgcaactcgcttctgggaccttactgtaaccaaacgtaagtataccccctcgggtgaatcacaacccaataagaccaaccaaccgccgagctacagcagatctcgaggagtaaggccagagggcagaagagaaggaggtcggtcatacaaccagagtagcctaaacctgtatccgccgaaaggagagggaaaccctctcggaagtaacagcaaaccccttcgctgctatcaatataactcaacagctcaccttctccctgcctgtcctaataaagcctcctataagccgggaaataccaaccggtcgagatagaggacccagtcccggccgaacagcaaagcattagggttatacaacggctcaatattcctattcagatataaggataaaaggctatcgagacccgtgctgattgggatacaggagccaaggtagatattatgagctatatctttataaggaagtatctcgagcaagtcagcgtgcctgtacccctcatacaggctgtaggggaaataatagtcccgacttacagggcttggaaggctataattacagctactgacttacaaggggctatataaatatttatataaatacttatcgcgctcaacagggacccgagaccagagggaagctctatccttctattaataactataatagaggataaagatatcttcttctatccgaaagggaggcagtagtagtataatataccgctaaagcaggttaaaataatataccctgctcgctttctacagtagtactaataagtagcccgagtattctcaattaaggcaattaaggactttactccttttccgaataagtatccctcctccacaaagggaaaagacaaggtaccgaccgagtttcaactgtataccgatatattcaatacagctaatacggcaatactcctacaccataaggctacggattacaatatcgagctccaagaagggaaggagcctccgtacgggcctatctacctgttatcccctgccgagctagcccagctgcgagaataccttgataagaacctgaagaataggcggattcatccctccaagagtcctgccggggccctaattctctttgtactgaagtaagacggaatacttcgattatacattgattaccaggggttaaactacctaatagttaagaaccagtacctattaccccttatatccgagattatagactgaatcaacggctgcaagttccttactaagattaatataaaagatacctactattaaatctgaatccgtgagggagacgaatggaaaaccgccttccgtatgagatacagccactttgaatatctcgtaatacctttcgggttaactaatacacccgcaaccttctaatattatatttaccaagccctgcgggggctcctcgatactgtttgtattacctatctggataatatcctgatattttctaaagatcaggatatatatacagcttatattaaagaagtcctggagcggatgtataaggctgaactatacgccaagccctctaagtatatattttatcagcagtctgtagaattccttaggtttatcctatcaatagaaggggttttaatagatcctcatcgagtacagactatataggaatagaaggaacctacattatactataaaatccaggtcttccttgggttctataacttctatcgaagattcatctatagatactccagggttacagcacccctaacggagttacttaagggaagtaaggataggaagaagcctgggaatctggtactccctgttaaggcaaagcaggcgtttcgcgcccttatcaaagctttccaaagtatacccctcctttattatttcgatcaaacccgaccaatcagggtagaaactaacgcttctaacttcactatagcagggatattgtcccagcctgataaggaagggcgttagcacccgatagccttctggtctaggaagttcaataggactgaggtaggatacggtactccagataaggagatattcgcgatcgttaaatcatttaaatactggtaatactacctcaaagggcctgagaaacccgttaaggtcttatcagactactataacctgcaagggtttataaagcagctgcggctgaacgggaggtaagcctattagtatatattactagcgctgtataactttgttattaagcaccagccaggtaacagaaaccctgctgatagaccttcgagaaggcctgactatacaggagaaactctaagcaaccttaacctcttgcctatactcgctaggaagatagctgctgtggaatccctccgagtaaccgcagcaggcttatatatagccacggaggcccaagtgggatctattcgctgcagggccctggccaagggagcccaggaggaaagccttatataagataaaggagatgcggccgagacccgactgatccctttggtgcaggcaagttcggagataagtctccctagagaacaatatattactagggcacaggcctgtcaggctgcaaaggataaagacatctatacgccggtaatctcaatatccctagtagggataatccgagaagcccagaaggctgataagatattagaagcttttaagaggggcgataagtatatgaaaagtagtcgactcccagatggttatataataaaccctgagggactactgtgttttaaaaaccgcctagtagtgccggaagaggcagccctgcggtatgagattataaggatttattataataaccctcttgcagggtattttggagggaaccgaacctgagagcttataagtagaaagttcttctggccaggtatagatatataaataagagagtatattcgagagtgcccagtgtgccaggggatagttataaagaggtatcagctatatagcgccctcgaacctctgctgatactctcttgtccctggagctaaatcagtatagactttattataggattacctatcaatatacgaaggtataataaagtagatataatattcattatagttaatagatatacaaaatactcccttttctttatagtccctagtataattactgctatagaattagcagagctattctatactgaagtggaactgcgatacaggctgccggagggtattataagtaatagaggattactcttcacaagcaacttctgggctgaggtccaatatctttcccgtattaagctacagctttcgacagcgttttacctacagacagataggcaaatagagaggataaaccaaatattagaatactacctccgctgctttattaataagaatcaagcaaattaggctaatctgctcaagactgtacaattcgtatataataatataataaacatgttaatatatatatcccctaacaaggtattatttagttataagcctaactttcaggttcgtgataaggatgctactgtcggagggagagtgccggaagcagaggtatacattaggaagcttgaggaagtttgtagctaactggctgagcagtagcaaaaggcaaataaaacccagttattatactataataaaaagcaccaaccgataacatttgccaggaagcaactggtaatgttatctataaagaacctccgcctcaagggcgaaaaacacaagttagcccctagaagggtagggccctttaaagtgcttaagaagatcagcaagcaggcgtatcgtttggccttacctgagaagtatagctatatctataatatattctatatgagcctgcttaaactgtagtacctacaaaaggaagagcaaaacagtatagaaataatactgttccccgaccttaaggataaggataaccagtaggaacttaaggaagtccgggataagcagacccagtaagataaggcttattatcttattaagtagaagggctagccctcggaatataaccagtgggttactgaagaagatatagctaatgcaactgcagctattcataagtataagaaggtataagcaaagaagagaaagcagctataaagcgtagagaaggggtaattctattaaacttttcaaacgggctgaaacccttacgagagccatacggtcattacatataactaaaaacaaaccaaaacacctccaggctaaaggctgcgacctattttccttacctttggggagcagagctcaacccgcggtcggcataacccgccagataaggtcccgaaccctaggaccaagccgagatcttcacgatcggtatatcagctacccaagcttaccgaatttcattattgatttcgagcccagtaacctccctatcactatcctcgagcctatcaaaccactcggaaaggcgcgagataagggaccgaactgcgatcctccagggcacaaaacccgtatcaccacggtaaacacataagagttaggtatcctcctaaagagccctctgggaagcatagcggtaatatacagtacggttgttcttctagattcccaagcaattagtatatacttacagggcgaaagggaatcgatacttatactattaaaagaggggcagcgactatacctctgcaggaggtaggtacagtatactaatatccaagtagtataggtagtaaggtcctcctaaaataccagagagaccaatcatcagtataactattgggaaactgggggagaacgatatgtacacacgtggtcttctgagacccggaaatattatatttttagcgataggttaactccaagtagctgaaggctactataaactcgtagataatacctacgagttgggtccgctgggcacaagtaaaacaaaagggctccttatcgccctcctctataggggcatccttatacccaacagcaggctttaggtaaagaaacttatcaatatactcgagtacatctataatatcgtgattattacccttgataccagccgccgtactaccccaaggattagcaactgaaacccaagttaggaatccaagaaaccagggctgtatagccgctaggggaatacttacagaatacaagtctgctgtatcttctggcagtaggtacagtggccggactcagtatcgaggaaagcatacctaattacggtgtgagaaacaggataaaacttggctggccccttgagggctttctcatcggataagatagcacttcggaggtatttcatacactataactcctcctctaggaggggataagaacgataaacatacttctgccggcgcgttgtagctgttttggtaatagcgctactcttcgtagattttaaaggtatactgcagcgaaaggataccgaaatacaagggtaacaagcgtttataaaaatgaaaaaacccaactggaaatagaaatatgtaataattccgtaacgagcgaagagtggaagaaacaggtacgaagagaggaggaagagggctgcaaggaagagggaaacccgactcaagtagggctgagggaaaagtgaacaacactagcacgcgtacctacgggtttgtttacatctacgaattgcacatacgcgctattactgccgctgcccgtataggcggtgtaaggtatcgcgaggctgttgggtcaccagctattgaaggggggataattgtaagagcctcgagccttgaccaggcttatcctcggagctacgggtcaaggccggctaaaggcatcccttcggccacataaagcatttctaacccacacatagcctacttggaagcttcaagctttagtactcaattaaattgcaaggcagccttattttcctctacctgactattataccctatagtgagactataacataacaatcatattcgtaataccagaatcagctataataaaaggattctgtaacttcgtaaaccggctgcagagttagcaggcgctagaccgggtagtagtagatgaataccacatcttacttaatagggaccccggattccaaccacagctgagagaactaggatccattctgctggagtagggtatatagaggatcttcttaacagctatattagcaccggataataagggcgagttcttacagacggtagcagtattaagtaagtatatccatatatttcggttacagataacgaggaaaaatatcaggtacagggtagtcagagtcaaggtagttgacccagaagagtaagaggaggaggaggatagaaaggtatataagatcgtttaagattggataaactgaggagagagcagtcgagtgatcgtatatatagggatagtcgagcgggttaagcggctgggggagatactagggtacttagtattctatagcgatatagatacagtcagggggaaggcggagaggctgagggtatagaagaaggaaggcaggctgatagtagtaataaatacattagggctgggggtagatataccgaatatacagctggtagtatataccgggataccgcggcagctacaggactatatataggagagtgaatatataggacgggatagatataagagcgaggcggtagtagtatattggaatcagctgaacaggggggccggagaggggaagtaggagctggcggtagaggagtttataggggaaggctagtaccggcggctggtactagacagggtaatagacggatggatacagtgtttcggttatgaggaggatgaggctacttataatatatacggtgaggtataattacagagagtaaaggaacaggagttattaaaagaggatgaggtagttagggctaataaggtataggggataacagagcagtttgagtatattagatagagggagaagatagatatatagcaggtaggaggggtaaagatacaggctacaggggaagtagaaatattccgagagtagttattgaggtagggagggcgctgtatagtatatataatatcttataggggggaggtatactatagtatagaagattatccgcagtagggatacaagaggtagcagagggttagggtaaatatagtgataattaaagaggagatatttgtaaagaaacaatttaaagagttcgctagatgttactagtacagcttgctgcagagtatttgcaaccggtaggaggagatagtagataaggatagattacagttcaggctattaggtaggaaacagtactagtatatagagctagttacaagtatatagggcggggtatattatttctatagagaggatataattagggaaatagatagaataataagggaaaacagactaataacagaggataaaataaaatagtttagatagctaggagagaaggttaaatagggagatatagagataaatcagctatatcaggggttcttccggctttatagattaatggagagagctgaattagagtattagagggttagaatttagatatatatatatatataccgctatactatagtggtttttttttagaggctatatttaaaaatcagccactggatcaggataaggttagggttaaggctgtacttatatttcgagagcagtatatattatagatatatataggtacttatattattataagtatagttattagatagatagtatataggaaagggtactaacggaagataggagggtagctgttaatataatagtctgataatagagaggtaatattctatatagataagtatattagtatcgaggattttacttacatactgtataaggagattatagaggcagataagctgctagataagctgtttagagggagtatagcagatagttagttaaaaggttaatatagggcgaattattaataatataatacagcttgaggcaggttagttatttataagtaatccgaagaataactagctagagtccgagctagcaaaggtaatacagtagtaatctgtaataatagctggaaggtagtatagtttatccctattattaatactataacagttcctagtaggatccattgaaatttagtaggcgaatttttatactactaaaagatagggggtaggatccgttgctaagagtccgttgattgattagttaataatttccagtaacctataaaaagtatttatttacccagtatttaactgaattagctagagtttagctaaaccactataccttagctaataacccgtactttagccgctctatttttactcgctcctactgaagtcagtcgcctaacacccgatatacttcagtaggagcgaggaaaaaaggaagaaaatctatacttttaccgctttattattctaagctagataaagagggatctcaactaggccttatcgaataaaaggatatattatttaaccagacctagttaaaatttacttactactcttctttgctttctacttctctataatagagctatttattcatcttgataaattcctatttattatctgcaagtattgcagatatatataccttaccaaggaggtagaaacatatctccaagctcaacacctattatttataatatcccagagaagagaaataaaggcagctatccaagctatagataggcttctacaggatcaagaggaactatacagatatctattaccaatatatactacagagccagtactatatatctccccgctaagaacagataggaagcaatataagcagtacctatatattgcttatacagagcgagggatatatacttatctataaaaggagtataattagaagagcaattggaagaagggcggtaatattaggaagaaaacagcagaggctcgcgaccagctgtagataagcggtatatattgctagtagttctttatccaaagggctgcgagcggctggttccatgttagctcaggtggagagactgctagccctattattaataccacaacggttcctagtaggatccattgaaatttagtaggcgaatttttatactactaaaaggtagggggtagaatccgttactaagagtctgttaattaattagttaataatttccagtaatctataaaaagtatttatttacccagtatttaactgaattagctagagtttagccgaactgctataccttagctaataacctatactttagccgctctatttttactcgctcctactgaagtcagtcgcctaatacctgatatacttcagtaggagtaaggaaaaaaggaagaaaatctatacttttactactttattattctaagctagataaagagggatcttaattaggccttatcgaataaaagaatatattatttaaccggacctggttaaaatttacttactactcttctttactttctacttctctataatagagctatttatttatcttaataaattcctatttattatctgcaagtattgcagatatatataccttactaaggaggtagaaatatatctccaagcttaatacctattatttataatatcccagagaagagaaataaaggtagttattcaagctatagataggcttctataggatcaagaggaactatacagatatctattaccaatatataccacagagccagtactatatatctccccgctaagaacagataggaagtaatataagtagtacctatatattgcttatacagagcaagggatatatacttatctacaaaaggagtataattagaagagtaattagaagaagggtagtaatattaggaagaaagcagcagaggcttataaccagctgtagataagcggtatatattaccagcagttctttatctaaagggctgcgagcggctggttctatattagctcaggtaaagagactgctagccctgataatactagctaaacagaagcagctattaaaagagttcaggagctctttaaggaggaggcagctaaggaggtatataagatacgaataattatccaggttggtaataaccagcttaaatccaatagatagcttgagtttattagctgggtaatatatctccaggggctatctgttactaagctctatagtataaggcaggatatccaggaggaggagatagtactacagtcagtatagaaggtaatagagtatatatttaaccaggtacaggcaactgcaactgctactaaggtagacaaggctgtactattcaaggtagtacgaactgctctagaagtaaagcctaaccggctatttaataacagactggaggaggatatatagaagcaatataaggatatattccgatagctgctatatattatatatcgggtggataatatagctgataataagaagctgctgtttatttttataatagtataaagcgatctctgggataggtttatcaaggctatatctaataagtataggcagtagagtaataaactaagctaagaggactataatctatacttaactataattatcagctggtttgattatatactgaaaggagatatatactgaaatatactggtgagcagcttagctattataggtatccgggaagatagagggtaggagtctatactaaactatatactaatctactcagctataatcaaggtagtatagatacttatactataccagttatactataagcgggaggtacaggttttatagtacttatagataatagatactaataatatatataataaggcggagagcgtattctgtatactatacagcaagatagtatagtttatagtatatatatatagaggacctgatatagagcctataccgctcgactggatcttcaaggtacaggtatacagtataaatatccgatataatataccggacagcagtagtatcgagtaggtagataactgtataagctactagataatccggttccgggtactgcagctagcggagatactgtatatacttatatataaggcagagaagctgcttggggtactaatactaaacgctactagtacagtagataggctcctggagattcaataggagcagtttaaggataaccagcggtataatataacggggtacttatttatacaggaccagtataatatatagctacaggctggagacaggtaggtgtttaagcagcttatacagtcggtattactctaaaagatatagatcagtataagcgctaataatacagagtatccactccaggagagtactatctataagtatactaatatactactatagttccgggagcaggtattcttactgatatatatactattaatactagcacgtgcgatagagattagtagggtacagatatagaatacagctaacagtaggctatataatatcttctgctaccggggcatactattcttcataataatatactataagaacctccgaatcagcagttacagcaaggtaatctactgctatcttctataggcagttggatctctactggtatagtatatatagctagtactgctgttctagcggaaggtatagggtattatcaggcagtataataatagacccagtatattcctctgggcggataaggtaattaagagggcagcaggtaatacagatagaagtatactaatagtagtaccggagcccgaatcagtatagtcagcagattatatacagtggattctgcagtagtacagcgaacgatatataggggctaagctaactattagcagctggcggtatatcgctattactactgctaactgctatctgaataaggttttctatatagaaggggatactgctgggatagaggatagggaggatagtaataatatcaataggtcagtatcagactatatactagatatccaggcagggtataggagctatatcgcaggcatagtatatatataagagctacagcagctaatattcggaacagtatagcagcagataaaattccagcggattagctagcagtagcaccggttccttaggtttaatatacaggagggaggataagcagcagccggagggataaagcggaggcttaatacagcagagctagcgcgggagggcagtcagtaccagtgcttctaccagctacagcaggtatccgtatacaggcagctccaggcgatactgggactagatatagtattccggggctagtaagagaaggtaatccggataattatagtagggataagcccggtagtatatattataggtacaggcagaggtaagagcttgatatttatactgccagtatactgcttaccggaaggggtaatagtaataattatactgctcgttactctatatactaatatatacaagcggtactaggaagcggggatcttaatatatatctagcagagctaggggctgagctagatcgccagtctggtattcgtaatacccgagtcagcgattataaaggggttccaggactttatccggcggctacaggcacagcagctgctggactgggtagttatagataagtactatatagttctggacggagttaggtagttccggccagtattagcagtactaggggggatcttatagttatagggggtgcagcttgtatttctgatagtaatactcctaccgggggaggagaagatattcttctaccgggtgcagattgcgaggcaccaggtatatatataccgcggcctaatacagcggaagaatattatatactcagtagtaggactggaaagacagcagagcgggaggagcagtagtaaggaagatagtaatagtaaggtagctgggctcaactagataaggaggataatagtatagtagaaggtacaggcaaaacccgggcgaataattatctatatacagataattatagaggtagagggtattagagcagtacttggatataagatattctatagtaagatagggatataggaagctaaggtggtacagctatagcggtagaagaagcagggtaagctgattgtagtaataaatgcgctagggatggggattaatgtgctggatatacagatagtactatatatagggctcctataacagctccgggactatatacaggagagcagacaggcagggcgggacaggcaggcaagccaggtagttcttatcagcccgagagatataaaagagagcagagaattagagcgggcagagcagaagggggtggatataagtatactggtatttatataaggatccagctactgatatcttctgttagacgaggtaatagatagatcagggctagggctatataaggcaggtgaggcagtatataatatatataccagggctaggcagataacagggttagagcgagataatagagaggaaggggggataataagtatataagtactattccggcagtagtagcagcagggtgttagaggtatatagctcagtatagagcgggttaggaagggggcaggggaggtagagtatttccagcagtagttagtagagtggatagactgctgctttttatacggggagaagaattataaggttagcatatacagtttactggagagcgagtaaggggttagtcttagagaatagattaagttggtgaagaaggagtacttccaggggaagaagatagaaaggtttagcggttgcttccgatatagactgctgtaggagatatataggtaatagaggtttatcagaggtaaaggggagcagttccaagaggtagagggataagaatacttataccccgagtttattacagaagggtatactgctgggctctagtttataccagggtaggtaactactattatagaagagcttctagaggtagataggtaagagattagactggataataataaagaagtatagtaatagcttaggagtagggttaaataggggggtatagagagtagtaatatatattaatatatttctattttattagataagttagagaagatatattaatagaataagtagttaatagagaagataagagaagctagatagatcttaactagggctagttaaataagatagtagtaggttcagctaggctgggttaagatatagtttaaatagggtaggtttagggtaagcagaggcccctaaccccaatatactagaaacaatataatagaaaggagaaataccccctaaccctaatataatagaaaggagaaaggccccctaatcctaatatactagaaaagagagaggccccctaatcccgatatactagaaaagagagaggccccctaaccccaatatactagaaaagagagaggcccctaaccccgatataacggaaaggagaaataccccctaaccccgatataatagaaaggagaaaggccccctaaccccgatataatagaaaagagagaggcccctaaccccctaaccctgatataatagaaaaaagagaggcccctaaccctaatataatagaaaggagaaataccccctaaccctgatataatagaaaggagaaaagccccctaaccctaatataatagaaaagagagaggcccccaaccccctaaccccgatataatagaaaagagagaggcccctaaccctgatataatagaaaggagaaataccccctaatactaatataatagaaaggagaaaggccccctaaccccgatataatagaaaagagagaggcccctaaccccctaaccctgatataatagaaaaaagagaggcccctaaccctaatataatagaaaggagaaataccccctaaccctgatataatagaaaggagaaaagccccctaaccctatcattaatgccacgacggttcctagtaggatccgttgaaatttggtgggtgaattttcacgctactaaaaggtagggggtaggatccgttgctaagagtccgttgattgattggtcaataatttccagtaacccataaaaagtatttatttacccagtatttaaccgaattagccagagtttagccgaaccgccataccttagccaataacccgtactttagccgctctatttttgctcgctcccactgaagtcagtcgcccaacacccgacatacttcagtgggagcgaggaaaaaaggaagaaaatccatactttcaccgctttattattctaagctagataaagagggatctcaactaggcctntcagtatcttagcaatggatttcgataaccgttgagcagtcagacatccaggcattagacccaatggcatcattcaggagcactgttatgagtttatgtaagctagagcagttatcgaggctttaaaacaagcaaacaaatgtgtgcggctagtgacagtctggcaagctcaccgtctactagttagtaaacatccgtttactacatcatcaaccgagctccgttatttcctgcttttaaatctacattcttgttgcacatatttcgctaccgtatgggtttgatgccacacagaccacgtggatttactgagtgctactttgcattggaagggtaaatttttatgagactttcaacccagtttggagtattgatacatcaactctactccctttgtagaaggatcgaatgatattccacaaatttaagtgggtaccacgggcctggaatccaggccttggagcacgctgaggctttccacggcgccaccaaggaagaaaggggcatccggatctcggataatcctactaaagctcagttccaggagatgagaaagtcgcagtgaggagagaattcaaacggggtgtcttccaatatgacaacactgttacatcatttgatcttccaggtcctgctttgtataatattatttttattatagtaggatgaagatcgctgtaccatcgagagtctgtggacttgtgttgatggtctccaccataacaactccacgcaggaacgccaggaaattatcagagcttagagggtaatctccgacgtttgaggccagttcatataatcattatacacgagtctcactaagtagatagttgatacctatttttcattcattttaacatgctacagaaagtttctcccttaatttcccttgggttaaggctccccgctgaccattgtcaggagatatccaaagggataggttgtcacggaggatgtgtatgatagatatgctctcgtcatcaggctccttggcaagcctgtcaagttcagcaatggcatcatcaaaagcacaacttgcaagatgtcgggcatgatcgtgtaagttcagaatttcatagtagaagaccgagacattgagagccaagcgtagtcgcaaccgatgagtggccgcaaactcggtctgcacaaaatcggtggcaatcttagaagaaacacagatttttcagtcaatactcttggataattcaaagcctagcaacagacttggaacccaccttgtaggcattatcggctgaactgactgcagctgtgagcttttctcccgacgtgaactcggctaagtaacggctgtagtcgcccttcctaaaaacagagcgagtcagcccaagcgctttcaagaagtgaagaccagtaaagtaggcatacatcgtgtaatataagacctttgagtcgacagtgccggcattgggaatcaggctcccgtctagcagatccaagacatcactacagattgtctcgagttcattctcaatcttcttgcggtatccgcgggtagtggtaatatgctcctcgttaacccttggctgtttctgttgttcgatcgataagatggtgcgcaagctggaacggcgggtgcagaccattctcgaataagcaatggcaagaaggctccgctcatcgacactgagctcaccacccgcaccgatgacttccttcaggtggaggaccatatcgtcgtaacgctcagccttctcacagaggcgagcgaggaaagaatggctaccgctatgtagttagtgctatggtcccgatgagggagatcgagtggccaaacttgtcgcgcttcatgattccttaggctaaatcttaaggtcactgggatagataaaccgtgtaatttgaattgggataatcttaggattatgtgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccgcttcatcatcgaccaagtttttgcctgcctgctcccgtttttcaccatggcctggagaggggcaatagtccccgtcgtcccctagactagctaaaagactagagctggaaccaaagtcggcatcggagtcgcagttggtgacgggtcttgctcagggccggcaagaagcaatgaatggcggtgataaagggagcctaggcacccaaggagccgataggccgatatagaatcgatctaaggcaaacaaatattactctgctagcttattcaagagctacccctcccgtcattcgcgaagggccggcgaacaagatgccccaccacctgctctacaggatgccggattagacactcaagcacacaacgtcactaggttcactagtaatggtgctcttctgcaccttgtcctcggcctcatgcccgggcagttcccaccagagatcaagatagacctaggtaaatttggtggtataacctttactctaggccacttttcggaacatatatccaagcactgctaaccaagctcgccataccgcattcaggaatcacccacgccaacgagttaattcatattgtctctgtagggatgatggcgcaacggggatggttgataaaatttaaaaccccgaagcccctttaagtatttggcgataccacaacggtagtatttggtgttgcaataggccgcggggtaggtgaattagagcgaaatagcgggtgaatgtgcaactcgtttgaagcgttgggagattgtgtagcttgctgtgggtttctcgccacagagctgcagcttcgacttggctgtaggatcagaggccacggctccagctttaccgagtcaagcttcacggtttcggtaattatcggtattgcggggatagtttccagcgagtgttgcttgggataaataggcgtctccaaaataaggcttcgatcgtaccctaatcttggaccatattggacaattgttccagtcgttggggggttggttcggttatactgaactgtcttggctcgaaagttcggccagcgtcgtgatttatctccagtatgaaaagcctgtgccccgctatgtgtcgctcgtcggtgggtaattaaaagaatggttaggaaaacgagttggcacaaaattgacgccgcaaggaccgcaatcgaggcgataagggagctttttttcgactccccaaagacgggcccgtctatctcgtaggccgcattgccgagatagatagtatttgctatcgatgccgccgaagcaataacgcaaattaggagcccatacccaaaggaaacctcgagattcctcaaggaccaactttgtaagaggcttggagacgaacttggtatagccgttgcaagaaaggatgccacccgatcacagccttcaagctgtggcagatatatctcgagcgcgtcaatccactgcttaagataatacacgcacccactgttcaatccctaattgtctctacaacagccgacatcgaatcgactccgctggatcaacaagcactggtgtatagtattttcggactggctgtatcggcacttggaagtgacgaaatcacaaacatgcttggtgctgaaaaacagcggcctccaagaatttcttaccgcagtcagcgtgtcgctggcgcagtttggttctctgggacggtacaacatggttgtcctgcaagctcagatacatacttctgtaagttttgatggcttttctgtgggtaatagaagcggctgacggtgaagatcatcctcatgggccaatgcaacaaacatgctgcctgggtcctgtcaggtgcactggtacgaatcgctatgagcatgggctatcatcgtgatggcacacatctatcactctcgccatttgaaacagaaatgcgtcggcgtatttggtggcaaattgtctttttcgacatcaagctgggcatcgactctggtttaacacacagctccgtgcctgagcacttcgacaccaaaagccctctcaacctcaacgatgcggacctgttccccgatgccacagatccgctagtgcacaaagagggacctacggagatggcatttgtcatagtcataactcgggtatcggcgtatttactcgacaagaaggctcgtcaggctatggaggcgaacgtccttggccacggcggagaccgtggaagcatagatgcttccttcttgaaccataatcggcttctcgtacaacagcttgacgctgacctagtggacattgaatgaaggtttattccatccgctgcaagtaaagtccacgcggcggccctgggaatccgcccacaccttatcagacggctgcacgacatgatgcatcctatgcaagaatcaccagactggggggctgatgtctagtctcctcgtgacagcctctgcaaactcattctctccagctgcgaaaacgcgagcaactcgtatgattcgatggatcgatggggctttgcgtggtatatccgcttgcatttcaactttgatatccttgccttcctcgccactttcttatttcacaatccgacgaattcgttggctaatcgcggtttggccgtgcttgagtcactttacgctaagcagtccttgttggacactcacaggccgaatgccgcagtcactccgtcacagttcattttaaaggccttcggcgagcgagagcgcgtcttagccgaaatgggagagatcgtcgatgttcctgaactcattgccaccctgaggcaaatgaatcaactgcacactctgactcctccaactccaactaacgcgaacccttggactgcagttgaatcgatctcgggcgactttatgcacgacgacggcacgcagcggtcagaaggcttcatgccgcaggccgacgcaggcgaagggttcagcgagaggtatgaattctggccgggggcgttatggaatgcggagtggggacaaggatacgatgatttgaaacaaaaccttgccagtcgcaattcctgcgggtatctaccgcacatgttaggatcccggacagcgacacgcgaacctccttttcatatcatgatgcattgggcgcggaaacagggctcattcagattgctcggcatacgggtgtaggtccggagtttttccggcgtacgggcatgtacgccccacatcacgaggtaaattctgtgaatcaaaattgctaacttccccgcttctcttccgcctgcattaatatttaattttcctccatcttgttgactcatgccacccttcccctaagggcgttgactatggtcaacgacatgctgcaatcggcagcggagctagcactcccaacacctgggccatccttgtcttttcacttctttccccacctccctgtcgagctccgacaaaagatctggcgctactctcttgcgccccggatcgtcgaggtccacgcccgcagatcgcattacgccgatgacttccaacatggaggtgtgccaaaatggcaaagcggttgtaacaatcctgccgctctgtctgtaaattccgaggcgaggtccgccgcattggattattatcccatcaaattgccccttgcgactattgcgccatgtgagcatgctggcgatagtattaacgacttgaatcgtgtgttgtatatcaatcctgaggtcgacaccgtcgttgtacttggcgatctggactatcgcagaatgtcgcacctgctaacggacttgggtcttcgtgatccgaaggggaaaggtctgcggagattggctgtcagcgccagctggacatatcatcaaggagctggcgacacaatcagaatgctcgttcaacacatgtttcctgaactgattgagatgaccgtgtttatgtatgctgaaagattngcttgactggtgtttagcccaccagcattggacccttgaggattggaagaacgtaatctggtcagatgaaacgtctgttatcttattacatcgccgaggagcctatcgtgtgtggcggacgaaagaggaggcttttgcaaggagcgttattcgcgagagatggaagggatcatcagagtttatgttttggggctgtttttcatacgatcgtaaaggcccttgccactgctgggctcctgagaccgcagctcaaaagagagaagctgagaaggaaattgaagctatgaataaggaattagaacctgagatgcggcagatctgggagctaaattcaggaattcaacgacttgggcttcgtacaaagccgggtcagaagcctcaatggagatggaaccaaaagaccggcaagttagcccgcagcaagaagggagggattgactggtatcgctatcagactgagatcttgaacccgaagctgcttccttttgcaaaggaatgtcagctagcccggccagctacggttgttcaggaagataaggctccgagtcataaccactatattcaacaacaggtctatgatcttcatcagatcaagcgactgctgtggtgtgctaatagcccggatcttaatatgatcgaaccggcgtgggcttggatgaagaggatgactacttctaaaggcgctccaaagtcaaggctcgtagccctagctgcttggaaggctgcttggaataacctcccgcaagagactattcagaggtggattgaatgaatccctcgtcatatccaagaggttattcgtcttgagggaggaaacgaatacaaggagggccgggaatccccccctgttaatttggtgtaactattctatttctagcttagcgaggtttcttagcgtgagatattacttttgaaatcgtcctccgtactatagtactaatagaatataggagtttttagtttagaagccttttattagagtagagtatattctttaaactataatagttttaatctaaagatactctttatatctattaagcttactatattaaaggtattattatatagagtaagagtaataatagtagagatagtatagaaaagaatctttctaataggggtaaagtagaagattatcctaataaagctattagtatatataaggcttaattatttagactaaagaatagaaagatatatagcttaggtttcttattagcccctttataataaataaacttaatagctatagtaggtatatactatccagtaatcaggtactatataatcagtatctgaatatctttatagcagagggtctttaaatacctatatcctatagtcttctaggaaagaaaactcttaagtttaaagtctttatctataagagagctattatctttattaatattattagtattagaagggagtaactagataaactagcttctaaagagctttttaatagatctatctttaggtttcttctacttactatctataagcttagtaggttatatactagtatagtatagtagctaataatagatagctagatagatatagtactatttaccagggaaaatatttatattatatataatattaaatattaaaataatatataggttatctatattaagaactagtttattattaatattaggtacttaatagctaaaataaggagctaagacttagtaatagtactagctattaatcagtagagcttatatagtatatagaatagcagctagctatatctatataataagagagagtctacttatcttatatactttcttagtattattctaatctatatactagctagtaactattatatatagctactgaaactaataaatatacttcttactagtactttataatataattttagatcttttatagatatataggaaaaagtcttatattattttaagcttaagattctgaattattatcttctagtccctaatttttatattagtatagtaactatattagttatattagaaaagtagaaactaataagataggtttaatagagtacttctatatactataactatttattaaatatcctgcttatattaatttcggttttagtagagtatttagacttaataaaatatactttatctaattatatataataaatagtatactatttaactgagagtataggcttattatttatagcttatttctctaccttataggtagtaaagctttaaagaaagattatataattatacaggctatttacagctgttattaagagtatagtagttaagtttactactatttagttaaggcagttaatagctaaaaaataaaaatagtaatatataggaggaaggaaagaagagagagatataggatattattagtatatatagagctaaagcagcctgctactattaatatttatagaaagtaatagacctattaaagagttataaagagataagaaacaggatataggtttaatatctattttaatcagagggggtagatagataaaagatattagtacccctaggctgtacttagtatatactatctattaaagcaggggcttactaggtactaataagaagtatagagtacctttctcttgatctaaaccttaagtatccctatactataagcgctagctaaaatagtagtaaaaactactggatttagtagtactaatagtactttctctgtttaatcagtaaaaagctatatataattattaactttatctattattataaatttattattatatatagaagttatataatatactctactttttctaactaattactaaagaattattagaatcttataataattctaataatctagaataatagattattactaactcttaataatctagtagtatatatatatatttattttattagatagaatactcttttagacagttattaataatattatttatatatctattactactagttctataatatctatatattaatagtaacttatattatatagtctataataatctaactatactacttagaataatactctaattagtttaattctaacttaccctagattactatttagtataagttatctaactattatatattaataactcttatttagctaattattttatcttaattattatataataataaagaaaatattataattattatagtttcttaagcttaatagtactatacttctactactactaataatctatctactctatatattaataatataatagataaggataataataataatagtagtagtagtaaactaaagttaaattccttaggaagtaagttttctaactttagaagtactttataactatataacaggagatagtaactataactaatctaatagaatagtaagctacttagaatattaatctataagcctaggcctagattataactaataggtaagagctagaaatactacttaaactattagtatctaagatatttaatagaatataaattaaacttcagggatttataacttaactataagtatattttaattatttccctattatttttaatactaataagaggtaagttatatatacctacttataacttaagggaaatacttttaattagtttaaatctattataaggaaataccttagtaaatatagaagttaataaattataagtattataataaactttaattactttatagaagttctttattaaacttttagaatataagataagaagtataagatagagtataagattaatttatttatttaaactagattagtattaatctttagtactaaatacctttagcttttagctagaactagttagaattataaatatattatattttactactttaactaacttaagaaggaaatctagaaagaactctataaagagaataaactagtaagtatttataattatataattataattataagaattaataactagtaatactagtaataaatatataaatagtaaataaactattatattaatactaataggctataatagtaataaactatagtttttagaatatatatagatcctatagagctagaagctatagaaaaatataaatattataattataataaaattagatatatcttactataatatataaagcctaagaagtagaagaactagaaacctactaaggaagaaagaaaataattagaaataactagaaaaactaaaattaaaacccttagaataattagaaaaactacttagaaaataaactctataattactatagtttctatattttccagaatacctactactacttttactaaaatattagaattagaataatattagaattagagtatattataggaaaagtaataataaatcttataaatcttttagaatcttaagaggaagtataaataagaaaaagatattctagggtttaaatctcttactaagtataagtatatattctattatactaataattttattcagaagataaataaagagtaagaataatatatatttactagagataaaattaaggctaaatataataagttatatatttattactagaagaaaatataagaatagaatctagatagagacttagaattaatagtttataggaaaaatactattaatactatctaatactaaggtaatagatataatatattaatttatataaaaactatagaaatatagaattattctatagaattataaataacctattataatatttagtactagatatattagaagaataaaataaagaataactttttcttatactttaatagaagaatatttattaaacttaaagatatttaaataatatactttatatattaataatataaaataaaactatatactatctttaagaaaagcctagaagaatatcctattaaatatatatataaagaactattagtagaaatatatagagaactatagtataagatttataaaaataaaaagcttaaattataatataattagaagtatatagaagattaagtaatatatatatataatagctaaattaaataatataataattaataatatagaaactataagaaaattaagtagaaagtattagaattagtaatatatagtaataataatataaatactattaaattatacttttaataatactagtattaggaggaagaactataatatatatataaaaaagaagtattttctcctactagtaatagaaataatagtaacttagaggaattagaaataatctctattaataaaaaagaataaaatatagtatataaaaaactaactatactaatattaataagtaaaattaaagaataaataaagaagtttagataatacttatctaagaatataatataactaaataccttagaaaaacttctctcttatatactaataaatataaactagtataaataactaaaggaataaattaactagataaaaaataatctaaactatctataatagagctatagtatagtataatattaataatagattagagaaccctagaagtaatagaagctagaagctctatttatatctttataaaaatagagattaagaggaactagcttatagtatttattaattatagagtatagaaaaattatatcttactagtagtaattaactaactctatttattataaagaaagaaaaaagaaatctatatagtagttaatataaagagtttaaaatttaaatataataataaaattattaacttagaaactaattattttataattaaaatctaagaaaagaaatttaatattatatataatttaatactactaggaggctataatattatattagagctattataattataaggtataaacttactaattaattagtatactagctatatagagtaataatactcttctaaatatttaaattagaattaataaaaattaaaattttattagatattagaaaaatatatttactttttaatatnnnnnnnnnnnnnnnnnnnnnnnnnnnnnnnnnnnnnnnnnnnnnnnnnntagatattagaaaaatatatttactttttaatatctaaaaatactattataaaaaatagtaataacttataataataagtaaatatagtagttataactttaatagtattataatctagaattataaaaaacttattataataagaactaagataaataatataaatcttaaattaaatatagaaataagaatagctcttagatatatatttagtactaattaattagaaatagctaataagagaataataataagaatataaaattaaatatagttaatagtaaaagaaaatagaaaagctacttttagaactatttaatattagaatctaagaatagagctaaataaataactaatagaaagtataatagaataaggaaagtaatatctagtataaatatatatagataatataatctacaggtaagtcagctatacaagtaagtcagctacttttacctattccttatataataaacttaattaaaataataatagctaattatctataataataatactagaaattaatttatcagatttctctccagcctccctataggttcggatattataaccaggctttttacaattactatattatagagtctttatataagcctgctctccttaactactacttctatagtcttcccctcttagctgcttatctatatccttctggtctaatagatctattctatcctatatagttagggatcctctaagctatatatagctttttttagctctttagtacttacttagtaccttatttactatataaaggtcctagacctcagtatataaaagagctacctgatatattattatagttaccccctttataaattaatctattacagccagtatagagatagaagagctattttaataagctaagatttaggatttaatatacttagactatatagttaccttatatacagtctatagtatctttagaacccagggctaccttatcttaggcagggtctctagtagtattagtatttatagtattatatctagctttaaaagaaccctctctagattatatagtattaggctagatctaataaagcctatctggatatttttctctataaagaagtagaagaaagctgtataaaaggaagagagaaacttaagcttactgatatagataatatatatctatattagcttcttaacctctcttctatataactgctttagtagtctaaagcagctaatatctaatagctaaagaagataagaggagtaaggaggtatatagattataataatcttatactcttaataataggtcttaaagttagctaaatagtagctcttatagctattaagaattagtatttaatatatcccttttatataaggagctatataggaattaaagtacttaatctaatctagactaactttattagtagttcagctattctcagttattataagctgctaattatacagtaggttatattcctaatactagttcttaagataatattagacagctaggataataaaagaagggatagcccagccagctgtatttaccccttagattatagttatctacttctggttaccaggctgaataagcttagcctttatataaccttctgatatagtaactactatcccagggaagataacccctattataaaaccagtcttattaaagttatatagatccttattcagaatactatattttgcctttaggttatatataagagtaaactaaggtctaataacctttagatctttatatttagccctctaatagttatatttctaaacccagtatatataaagctctagttactacttaataaaattagaaacctaattaactctaacagggggtatattatatatatatagcaggatattagctatttccttaatactatatatcctagggggaaatatatatatagatagcttaattatatataagataatagcctcctcctcttcttttataagaattattaattttaattaagtattatatcttactatataaccagtatattaatctataaaggttattcgcaggatattatagagcttagctacagctctaatacttagttttaggtttctttaaatagtctggatagtaagtaatatatttacttcgtacgatagttcagttattttatattatagaggaattaaagaggttattaaagggaagagatttttagtagaagtagctgacttacttgtatagctaactcacctgtggattatattaagatacttagtaaaagaagaatagctaaagaatattctagaaaaatatagaatctataataaactatttaaggaaacttttaaaactagtttatctaaatataattagtagaattataaaatctctattattaaagaaggaaagctagttttttataaactttataatcttataaaaccttagttataaatactctataaatatattaataatatattagtaaaaagctatatataattattaactttatctataggctactctataatatttatattaaaaaagaatagaaaactataacttattataaattactaatagcttaataaaattatatataagaatagaatacctctattactaactatagaacttagaaactagttatagggaaaacagtagtttattatactagatcttaaaggagtctataatctaatataaattaaagaaggaatatatatataaggttttagagaaactagaagatataaaactcttagtagaactagaaaaaagctatttctatataatattataaaaaagagaatagaattttaatagaaagataaatagtaaaagatatttaataaaattaaatactaaatacttttagaacctatactatagatatttaattctataaaaaaagtagaacttaaaactaatactttagattttataattaatatataatttagttaaaaagataataatagagtactataccctatagtattcttcttaaagaaactatataatatagaacttaattactctatctataataaggaatttatagctattatatatatatttaaagagtttaaatactattacttaggaataatatataaaattaaaatatatatagattataagaatatctaatattttactataatctagtaacttaatagaaaataaatttactatatagaatatttattctaatttaattataaaataatatattaaaaagaattagaaaatagaaaaactaatacttttagctataaactagaatataaataaactatacttaaaataaatagatagttacttactataaataataaagaatacttagtataaaaagctttagaaactatacttaaggaaataatatatactaaggtctagataaatactatttctagcttagaaaaattataatagaaagtaagaataatacttattaagaaaatctataaatatctatttttagaatactaaagaattaaaaaaatatttaataaaatttaataatattataattatctagatttataaaaaaaaatataaactatagtttcagaatataatatatatatataaattaaatctatataatataaactatatagagaacttaaattagtttntttttacagcttctgcaacaggctggactaataacgagatcgctcttgcgtggctagacctaatctttatcccgttgatgaagcccgagaccaagaggcctaggttgcttatccttgatggccacggaagttatacaaccgatgaatttatgatcaaatgcttccagaacgatatattgcttcttttcctaccttcgcattcatcgcacgttttgcagccgcttgatatatcagttttttcgccggttaagagagcctatcgcgaagagcttgcgaagaaggatattctaattgattccttgctaatcagcaagatgaccttccttgagtgttattcaaaggctcgattgatcggtctaacagagacgaacattcgctcgggctggaagggatccggcttgtggcctattaacgtggctaaacccttgatgagcccgtatgtgatgaagccggtgtttgggcccttccgggcacccttaacacctccctcaactcctccaagggccgggatgaagcgtaaatatcattacgaaccggatatttcaacgcccaagggcnnnnnnnnnnnnnnnnnnnnnnnnnnnnnnnnnnnnnnnnnnnnnnnnnntcatcgatccaccgatgagactgctattccggaagatttgcaagggtcttgacgaacaacaagtgaagatatcacttaatacagtgaaaatcgtacaattagagaggcaaaatgagatgctaaggccgaaaaaacgaacccgattgcttcctaatccgaataacaagttctcaacagttaaacagctagccaaacaagcggcacgatacgatacgatcccggatgagatagaggcaccagaggaattagaaaattatatctttgaagagctctgcttccagtggcaaattgaatagcttctcgtattaaaattcattgaattgacgttgttgtgttgatttttgaatctatcgctattttcatctgggtgttcggttgaggggggtgttcggttgaccagggtagcaacttagagtcaatgtattacccgtaaaggaagctgaaacccatgttgatattatgtcagcggtatctaattctccgcaaagatttacattgagaagctgacaacccatgtatgtaatttagatttgatggcagcacctgtcccattaaggtacgatttacgagtacacgtctcaagcgctgctggaccttggttgtttacaaccagaaacctctgccttttctcgcctttccgcaattacatcttaatccaaaatcttccagataacccgaatcctaaaatccaagtcgtctctcaatttatcgtcactctgtgcaagttgccaagaatgcccacgttgaagatgaaacatacccttgactctatatgctagtttcggcctccaggtctcgccctttcttagttaatcatgcttactcttccaaaaataattcaccgtgggtctatgccaatatttccagaagagcggcggccttctctacttttgtcatcaccatcgccacccttggagagcttcgggacaaattcgcaccttgtgcacggaggagaaaccagacattaacatctatccaaggctaatcctcgatgggtgttgtgcagcgcatatccgtcacagacctgtcctcgtgttccgcctgatggagatttgtgcaggcctcccgatgctgcgcttcatcgcatatgggatcctcctctttgctactctcgtggcctccatctcccccatctcgataaagggctcgaaactatatgatcaagatggaaagcagttcttcgtcaaaggtatattgctgcctaaactacgtttcacttttgtgcgcaacactaatctggactcactgctgcaggtgttatttacgcgggagtgggagagattgacgtattgcgtgacggaaaacaatgccagctcgatgctggactgatgaaggatctgggtatcaatacaattcgcgtctatggagcggattctacaaaggaccataaggaatgcatggaggctttcgcgagcaaaggtatctatgtttgggtggacctgtccacagagtcaagaaagatcgatgatgtaagtgaagctaaaccaagagcctaattatgccccgagacgctgatagaacgcccagaaaacaccagagtggacaatgaatctatatactaacttcacctcgactatcgaccatttcgccggctatgacaacgtccttgcctttactcttggttttaataccctagataacacgagtatgtctactggcagatcagtattgaacttgcagctcctaattagataattacagtcaagggaagcgttgcaggcattgctatcaaggcagccgcgcgagatctcaaagcattccgagatgcccgaggttaccgtccgataccgatcgtatatgcccaagggcccgacgaaccacacacaagcaaatgcggacagttcgtcgcctgcggtgacaacacggttgatatgttcggcattaacaatgatatatggtgcgacatctcatcagggctcgacatgatgcacgagttattcaaagactataacatcccgattgtattctcggaaacaggctgtggaggcgacaataagcgcaacttcagcgaggtctatgggatactggggggtgatctccctggcaagttctctggtgttattgtatatgagtgggctcaacaggagaacaactacgggcttgcgaaatactcggataaggcgcagacgggcactccttcgctcctcgacgactacagcaggctattgacggcgttttcaacactgaacccaacgggcacatcgatgacagattataaaccgacagaaactgcaccggcctgtccagattacgactcggtatcgcgctgggcactcagaggagatattgtgcctcctacaattgctggggttgatattgggacggtgacggctcgcacaacgtatattccgtcaaagagccccgacactacttcggcaactggaactataactggtagtggtggcggcggtgggggaactggtttaacacctgatgacggcacgaatgcagaaggttcagatggctcgaaccagaaaggaaccgccctgtcaagaggcagcctgatcggagtcatagtcggctgcctccttgcgcttctggcactgttggcgcttttagcgttcttattcattcggaggagacaagcgagggggatggagaagctcgacaaagcattatctacagtcacaggcggagcgaggggatccgagggcgaccacgatgatagcaactggtctaaaatagttgtctcacccaagagtgaggagagggtggaaagatttgagctgccgacatttaagcagagatcttcgactccgcggttcgagttggatgctacagaatggagtcaaagttctagagaagtcggtttcgaaaagggcggcgtatctggacatgagcgtaatgcgttatccaacggagggattgctccaatagcaactattgctaagccagcctccatatatgagttgtctgacacaggtttagatcacccagtacaaagatagagcaaattgattttcaaataagaagttttagaaaaatgagcatagtagctgttagcaatatatgccaaactgtgcgaagtgatatatgtccaaagcagttattcaaatcggtgagaattgttgccacaacaatgcctttatttggatctaagttgggatacatccactattgctaaggtcgtacctcgaaagaaaatatagcagtattccaagctactggcctcgattacgccatgagaaagtagttcacgcaagcgctatgtgaaattgaatttttctcactgcctaaattccctcccctcctatatattagtatttggtcggcatatcactcagatactgatactgattcagctttagtaagccatgaattccgtcttaagcaagtgccatatgaaacctccaaaccaatgaacacagcaacactttcggataaggcaagtgaatctatccacaatgaaacgacgcagtgaaaccgtgtcacaaggccctttagtgactatttttaataagtgtagtaataagtgtagtaccagttgacgtttagtctgagaagtaacactaacgtccatcgcttaacctcaatactacaccacactactttatgctctctgggattaaggcccgtctcccgcctcaagtcaagcagtagtgattatcaaatcttttgaatcttgtaagaatattaccctgaggtagtattttacagcgacagagtctccgtatacttttttttcagaagatttcagtttgccaagaacctaaacacggctaacagcctaaatctgctgttttaaatacgagaaaggtaattgagccaagaaatcatcagcactcatataccagaattggatagattgaatgaactttttattttggctgcaaaatatcgtatgatatagaatgaaatgaattctatataaactccatgacaaaggctagaagagtaatttgaagacaagaataaaagctttagtgacaatcaaacgttttgtgttccatctcattcgtctaggataaggagaagcgaagtaggccatagtgttcgttttcatcatgaagatttcagcagctattctcggcttggtgagccttgggcaagcccactgtaagaaccacatttccaatagcatccgtacgccgctaataaataagtagaccacttccatacgacgatttacaatgacgttgcctccgagaagtttgaattcattagagagattgattggaatctccgcgacggtcctgaactcgacgtcttcggcccaaatatgacctgcaacaggatgaacgcgaaccctttcacggaacaaggaactaaggtcttggaggtcacggccggctcaactattggttagttgttatctttcatgtgatgctgcgattatcagcggaatatctttgactcaccaccattaatagacttcgagggctatattgaaatcttccacccgggcccgctgcaattcttcctagccaaggctccttctgggacaaaggttgaggattttgacggcctgggcgatgtctggttcaagatatatagtgacggcgacgagtcatcaatcattgacgaaagattgacctggccaaattggagtatactgctctcaaaaataccccagtccgcgcgtgtagatactaacggctggaatcacagagaagaaccgcgtatctatcaagatccctgaatgtgtcgccgatggagagtatctacttcggctcgagcacatcgcacttcataatgcttcacaggataatggagcccaattctacatttcttgtgctcagatcagggtcactgggggtactggaacacttcaaccatcgccttcggatttgctagctttccctggttcgtacgatcctaaggatcccggcttgttccttcatatatagtaccctatcccaacgagctacactgcgcctggcggcccagttctacaatgttgatagatcagaattcgatactgtgtatctcaaggcaacttatttaagctcgagacagctctttgtgaaaatcatttccgtttatataatttaatacagcggctcaagaagtaagaagtgtaaaatatatatattcagctaaaaatctcatattattagcttgctattaattatatatattaaattcattgtattgagaaattgggtctagtaccttctattagagtatactttagataacctctataactacacctcaggtcagtcggatgccctggttggcaagatccttgttgaaactggcccagcacacgccggactggaaggtggtgcccatgttatcatgattgggacgcagacacttcgagatgtaggcaaatagatgctcacaccgcccaaaggtgtactagtctgggcttagacgctcctttcgccggcataggagataatgggaatcgtgtacttgtggcaaacaaaagcaatcccttgcgcgcgtttggtggttctgggataggcaaccgcaacaagtaaggcagtctcgtcggagctggcacagccgaattctggagggccagtttatcctggccgagaccactgatcaaagggccaattagagataacccccagggtagatgaggggcctgtgtagccgctaagtatgttccaaatggagtggcaagtctcggcgatgcgaggctcatcgtcgaacacttgtctggtgcatcgcccagagtagcccaactttgattggtaaataagattgactcagatgacagtcttctccttggctgattcgattcataacactcagaatactggatcacgatggtctggatataacaagctggagatgatcggttatgaaacgaaggattaaaactaagtctaggtgttttattgacataaaagtcagttattttcttgcttcccgtccctctttaaaacgctcagagtcccagactagccgaaacttctcaatgccggagagcctatctcttcagatcaatcaagactcgtggacggggccgaaacatcatcgactaggcctctttccgtatagctcattataataagccttgatattcttcgagtttcctcggttactgagtcctcgttggctaggtctctttccatacagctcttcgtagtaagccttgatattcttggagtctcctcgggtactgagtcctcgtcggctaggtcgctttccatacagctcttcgtagtaagccttgatgttcttcgggtctcctctggtgctgagtcctcgtcggctaggatggcccatcagagcaggcgctacgagagtcttcgtatgacctcctcggacctcgaggggaaattcgcgagtgtcgagctcaatgttgccgaattcgcgctcgtagatctcgccatcaaagtcacgagtatagagttcctcggcatcggatctcttcagcagcgtaagaccatctttgccttgatcaattccaagagcaagtcccttgccggcaagggagagccagagaagtcctgcaacgccaagatttttgatagcaaccatctcagcggttaagaaataaacaaaggaaggaatttggaaagataataagaaagtactgagagaataaaagctttataagtagtattgcagaggcaagtaaataaccagtaattagaagttatgtgaaagattgctctttatatatttatgtaaaggaatagacagcaaagatttatttttatcattgactctctagtggcaagtgatgaaggtatagctttatgattggactgtttccgatttagtgtctcacgtcagatgttagtatcttatttaatgatgctgtctccatatcaatgccacacagatgtcggcacttctcgcgacccctggcactcgcgatacatggcactcgcgacccctggcaatcgcgatcccttcttttgtggataatgaagtggacaactgtgtacatagtattactattctcggaatttccgccaactcctaatatacatgtacctagagtgattagggccaagcatcgcgtatattctttttttggccgcgaacgggattctttaccagaaagagactgggcctgtgacattctaggccacctttacttagctatcaagggctgtagcctagcgagaacatttgcagcttagacctatgtatatatagaagtagcaataccgatggcgaagcttgatgaaagagcgagtgatcctaggccagggcctagttttcctgcaaccaccgctccgtcccttgacaatctgcatgaaaagtcgctccaagagacaaagacagttcgtagtcagaaacgatattaccaatcaggggacatgatgctgtttcgatttgtctttggttcgatgaaccaagatgtacatccgctcgcccggctgtctcgtctcaatggccagacaaccttgtgaccgaagcgcatatgactacggattcatgtttggccgctgtttggttggaatcggctcggatctcgggctgcagagtaagattctgagaccaatggattcaagccaaaacggaaggagcagaagtcggacggcacttgtgataagttggtgcttagcttcatacgactggctggcatggaacatactcacatcgcagccatggccaaggtatgagctgagtcaccgtgtcctggcgacattctccgccttcttgataatttcaaatttacgagtttgtgttgctggatgaactttaccgctaggccaatacccggacatgccggcgctgataataagatcatctacgtcttgacgaatctttgagatttgttcgtctaggtggaaaggaagacttaatcatgtttccttctaaacttgaggcttgggaactcaattacatgtaaatagtttatgagataaaccaaccttatgtatacacaaaatcgtttcaatagggacatgtgttcaggaaagggttgccagcctccgaaaaacaaggtcgggtttacatagttcattacataatgctgaaaactatttacccgctgttaaaccgagaataaatatcaatgcagggctactgtgcttacgaggcccttcttcttcatcgcgtcacttctcgtagcaattatgtttggccaacgatcctccggactagaccaattaatacgtcgcacaaagcgtaacccatggcaagaatttcgcgaatggccttgtgtctttcttgccaaacaggtttatgcatctcggagtctcattcctgctcagccagtctcaaacgcggtttccgttgtgtgcatatccgatacccataactatcagccagaattgcctgatggcgacatactgattcatgctggggatctctcgcagtcaggcacatttgaagaagtccagaaaaccatcctctggatacgtcaacaaccatttgagtacaaggtcgtaattgccggaaaccatgatttgatattggatccttctcgagatcaagacaaaattgctgaaattggatcccagctagagtggggtgacatcatttatctggagaactcctctgcaacattgacttgctcgaatggtcgccgcctgacggtctacggcagcccttgcccgccacaacatggcaactgggcattccagtatccgcgacataatgatgtgtggtcgggaacctcttttggcgatattgatatcctcgttactcatgcaccaccaagaggacaccttgacataatgtttcttggctgtacgtatctcttgtcaaagttgtggcaaacccagccgttgctccacgtattcgggcatgttcatgaaggctatggccaggaatggttacaatttgatgcagttcaggaagcatacgagcaaactattgtcgctgggggtggtatatttaatcttgtctgccttctataccgacgctctcttgcttggttcgaggcccccttggagtcgcgatgcctattggtcaatgcagcaatcgttggcggaatctatgatgagaaaaagaggaagcccattcgggtcataatttgatgactgatattcttgcttataccgtctagctagtctagacgaaaagtgtatgtggatcctctacaatgatattcatttcaaggaaatggggactccaaacctgcttaggtggcacctttccttctttgtctggaatgattaattgacttgacaacggggccacagtccgggaccattctggggtttgttccggaactctaggtcttgctcgtagctccgcttctgccttcggtccagcaatgatagcagggctgcctcgaggtaaacccttctcgatgagacggttgaatgcagtgacgagatagattggcaggacagccaagattgcataacgttcagggtctgggtcttgtggatccggtatggcggaaacagcccaagtgggctgattaaagaaaaactcgatctccgtcctgaggccagtgatgtatccaataacgaggtactcgtacattcggtacaacgatgcggtgggattccggccttttgtaggcgctcgaactccttcgagctgtacacgatgctctagcaaccaggagacagagggcagatcccctaattgatcggatttgcgtttgcggagcaatcggctcagaaatgaagaaaataaatccatagcgatactgttggaatatccgagtattggcttgataggtttgagatgatatttactgagttcatttgaataatagcgtttattcgtgacgacaagtcggaacgcgatggtcatataacgcgcgcgttctgttccaggaatctgtcccccgtgtcacgtgattcatccaatctagtttaccatgctgtggtatcattcgtaaataattttctctgtccaagagagtaccaatttctatctcactaacaggatattgatttccagatcgttttccttgcagagttgtttgaaagaggttgggttgtcgatgtgaagatttatttctactccaggtgtagtgagtaagcaaattgactgatgagccaatccttggggtaggatgatggataagatcaagagaaaacaaaaacaaaaaaccaacaatatccctgtttcttcaaatctggaagccaagtcttgtaattttcgcatcctgagctgggttcaacgccccaagtcgtccggaaacttttgaccacaaccataacgtctaattgatgatgcggcttatcaaaagcaacaagctcactataagcgagagaaaggtcctgaaatacccctaagagaagagtagctcctcgacattatacctagctagaccggcgtcggcggaagttaagctgaattgccggatcggggaaagacgcggcgtgcttagttctctgaatccctcacaaaatccacttcggtcaatcagtgccacatgaccagcctcaagtcatccgatatcatcagcgccggtcatgcagaacaatcccgaccctacattaggcctgttgccgcattgaattttattttggtcagagggaagggcggaggcagccgtcactctcacaagcaaactctgcgtgcatcatctcccaagattacaatcaggcaattttttaaggtccacccctgcccgtccaatcccccagacaaagtgacgttctgggcaagacggggattatggattttgcgtgtttactagaatagtcttccgaagctatgctctttgttttcttagtcatgcggtggaggcttcgctcccgaaacacacagctcctcccactgaatctgacccctgtctgcagttatgcgaacgccccagacccccgattttaagaatttatcctttcttggggtcattgcggctgaattccttctcctgtacgcattgtgacaagcgaggaagcggaagatggttgaccatgcttcattgggctagattattgaatggctggactggacagtccggattgaacggatgggggccaagtatatgtgcagcagggctatgaaaggtgcgacagacgctcccaaggcccaaggactggcaggattaggggctccacggaacggttttcccttcctttggattttttctttctgttccatgtatctgtgcgtgggggcaacttgcaggaatccgacaaaaaccagggctgcatatatacaagcaggtagcaatcaccaaccgctcttaacaggcatctaattattaacgatgcgaaccattgcgagaaagcattgttgttcgggcccggctgcgtgtcttctaataactgattgccctaatccatgtatggctttcgtagccggccggacaacatgatgtcatgccatgttgcctattggcggttattcccagctcctagccagctggctaacaacctcgggaaggacggtttagttcctcttccctgtctagtgtgttcctggacgggcttcccctgtttttggctttgcgcgtacactctataaattaatgctttgatggcaaaataaataaatgaatccaaaaactagaatcaaggcggtttgaatgcttagggccagggcttgcaagatgagtgagcgagatttggccccaggcgcatgggtcgctgagatccagatcctattccttcaacttcggaaattggttttttctcttcccagcctcgtgggaggccttgtataccgagccgtgtgtaatttaagtgcaatatttccagcaattaggacaatcctcgcaacatcaatgaggataagacaacgagaaggggatcagggtcttgtactccaccggtggcgatcgaaccatcaactgccaaacacgtggtttaggcagtctgggccaattcgcctgaacactgcgtggcagtgctcagatacactctaggccaaggacgaggggctgggtgaaattgggtagctacaataagctgactccccacagagtagggaactcagaatgcccatgtcctttgcgagactgcctccctcatgaggacaatctactctccaagctggtcctgccccataaaaggatcttactgaaatcctgtacgaaacgggccgttaacagctttatgcttctctttgagggtgtatggcccgtagatgaaagaagagcgaaccatccttctttaagaaatcatttgcatatgacaggttattctcgttaatctgtagtttccactatttggccgcggtgtcgaccgagtagtcgagctcaacatctgtggctcctaataacgtgagccattttgttttacaccaggatgcgcaagtgttaaaggaggagtggtggacctttggagaccgaatatttagggggcagaatacgtagaagataacagatctatttaggggtgaggtaacatttctttctgcttacatgacaagtgggtttcagaaaataaggactaatactcttgagccatgatttcgtgaagtgttttaaaacccgaggtttagagccttgtctaaaccgtcttgctttataagcggatttcgtagtccccgtcttctgacacctatatgcatggatgggcaaggagctggcgggagtataatacccgatgaggaaaattcgaatgccggcgctggatcattaccaaggcaattacccgacgcgattacagtaaatctattttaggacggcgaaggtgaagactctcactcttttccaagaaatatattccttctaataataaataagtgagcaaaccaagattttatatctaaatatacagagattaacactatataagatgatccttctcctctagcctctatcttctattttaccattatctttcatattcttttattctgcaattatcctttacacttatttatatcatctttttcacaatctgcaaataaatcttcgtcagaatggcttccctcaaacaactctctgtagctttggctgctgctattctttcctttccgaatagaactgtagctggatctgcagagaccaccgagtttactgtccgttccgatagcagcgctatccagggcggcgatttcgcaaccagatctgttgataaggaggatcaacgcaatgttgcagctcggggtttttataagctcgatgagcgtggtattgaggaagagcttggcctcagtaagcgtggatcaatgatgtgccgtctctgcaagggagctcatgctacatcaaaatgtccatttaaagacggccggaagcgcagcctcaataagcgtggctcaatgaaataccgcatctgcaatggagctcacccatcaacaaactgtccattcaaaaaagggcggaagcgcaacgttgaggacgacatcagcattgcagctcgggatttttatgaacttgatgagcgtgaaattgaggaagggcttggcctcagtaagcgtggatcaatgatgtgccgtctctgcaagggagctcatgctacatcaaaatgtccatttaaagacggccggaagcgcagcctcaataagcgtggctcaatgaaatgccgtatctgcaatggagctcatgctacagcaaaatgctcatacaaacgccattaaagggtctatctttaaaaccaacgaataagagcacctatagtgcaagttatctccaagtattccttaagttttataaatatagtaactggttttatagatactagtattacttctaaataatttattcttcttaaattagtatggaggagattatatttaagggaaagcttgttacaaacaaaggctacttgtattattttcccttctatttttgctactgtaattggcaggcagcctatactacatacatgtacaccggcgccgtcttctactcgcagtaccggcgatccagcggtaaaggttttctgcagaataatagcctgaagtagcctctacaatatccctgttctagagctgtttggtttaggatactggtttataatatggagtacatcgcggatcagagcattgatgataaacgttgagaaaatggatcagatgcatgtgaacctccagaacgatgaagatacaggctcacctaacaaataacatcttagaaagtgactcaattcacgcatcgctaggcccaatgactagggtccaaagttttgatttcgatcatagcttagggctggcagtgccgctcgcagcctgtgtacgcagcccgctttgtaaaccttgtcgcagaatcttggccaatctcttgacatcgtccaaattgttataaaatccacaaatgacactcgaataccgagcttatatggcgagatctgcactccgttttccttcatgaagttgacccaaccctccccattgatatcaagaatgtacaaatgaggggcatgttccttccgagactggggtccgatgatctttattctgagttgcttacactcgtctcttagtgtatctccgaggctgaaaagatagctctcgaccgtcttagggcccatggtgtcgaggtaaaatgtcaggtggacctcagcagctgcaacggcacttggattctggttcgagtgatcgaatctctgagcattattctgaagaagaatgggatccgccacatccactgtaaagtcggcccttctttccgcaagggaatcaaaggtggtcatggggggttccgggttcagcccttcaagaacttgttgattaacgtaaagcacgccagatcctgtaggacagtttaggcccctgtgcagactgaatgctgcagcagacacaccaagtgcttgcacatccacgtgtgtgaagcttacttgttgcgtcaagtccgctaggacatggatcctttggggcctgtatgggtcgcaaatgtctttcacatcgttccactgaccgctatggaacatgatggagctaagtccgatagcttttgttctttcatcgatgtatggcgcaaaggtagccgcatttgccgcagtcagctgcccagtgcggtcaacttccgcagtggttgggacctgcctcacttccaaaccctgagaccggaggctcaaccaaccaagtacgtggttaggatgctccgtgtccaagataacaacactttctcgaggagagaacttgatgctgcggatgagatcccagagcatcggttgtatcgcgggtgaaggacaaagtcgatggttcagcattgatacatcgtcccaccaaggcgcgagtctcctctgcaaccgcgagccattgtgccttgggattaggattgtacgatgcttcgttggagaagcgtgaaaggcaccatgaacaagcagatttgacggtggcataaaagcagaattgaggtagagtacatcgggattggacattaaggggaccaccttgatataggcagcaaatgatttcctatcatattccacgttgaagtgtcgatggaggccatatctttaagtctgagtaatgtataatatttgaacgattaggtctggatgatctgatctacgaaagttgaaagcgaatgcttagtgctatatataggattcttcctcggctactgggggcaacaactaaattatttgacttgagccggctaaaaccaccgagactcatcatagccttcgcgtaaaatgaggctcgggctgaactgccatggagtcctatgtccgttggaaatagtgccgtgaccggaggtgttcggggtggagcctccgcagggcggggtcctccaccaagagggaacacagccggccgtttactggttagtatagcgatatgtcatctcttaagtaaagaagacttaaatataggggatacagtaagaatagtggaggcattttctagatattaacctatgcctgaaagagagtggtgggagaaatctgatctcagctttaaacctagtgtttaacacgagaacgcctgctcgtagcgcagggcagccaaaatcatttatgaacaatacatagatagaacaagaaaataaataagtaactatcaaggacaactttacgtgaataacaatcaagatacacataaggcgggcattttcttagcagaaaatctagccgtttcatgaatctcccctgcaattcagtactagcttctcaagtgaatgtatattgctgaatagtaatatcagcggcagtccaagtcttcccaccgtctgcagtaaccaggttaccagaggcaccaagggtcgcaacggtccgagagtagtttggatcggcagtattcatgatgatcttcgtgtccacataatggtgcaaggggacggttccacagttcacctgttggcactccattgctaaatgagaataacggttagcagatttattctaaatgaaaacctttgggatagtttaattgacctgttccccaacctgcaccgtgaccgctcgctttaaaacagtcagcatacaaatcgcactacgatctagaggggactctatacctgtggacaaggtagacactacattgccgttcaccgatactgtctggtcgaatttagacgtggcatcattatacttgtctgtggaggtgtaagcacagtaatctgataatctcccatgaagggacgcttacagtcatatgtaacacggtcaccaggatttgctcggtatggcgtagtaccatgagtttggccccctagagatgtgtgagagccgatcatacgagataagaggaaccataccgtcatatgtgcttgcaaccacgcaccacttgttttcattggcagcaaggttgcatggagatctatttatatgagctctcgcgcctgcagacttgggctgtaatgcgtgctcacccaaaaccaacagtcgagatggcaagaccttggatgagatgcccatctgcgcctgagtcaaacttggtgcccattcctggccacaagcccagattaccgttgtgagggctgttgagggctggcaggatcagggttgtagtcgcctggcgaatccatgaattggttgcgactgcgcctgtcgaaaagtagttgccaaaactaaagtagttttgacgaggagccacggcagccgaggccacaggaataccaagaagtaatagcgatgacttcatgttgacgaaaccgatcaatgatatgaatatttctcaagacaagtagaaaaagagcacaaaggcttgcagaaattgcgtgatactgtaaagatggaaaggaaaaagggaagaagggaagactcagaggcctttttagccacctgaggattacagtaaggaggatttgagaagggcaaaattatcttactcgtggatttattagtgccctacttttgaatctacattcacattattagcatagtcgtgagacaacaagtttcagattgacttatctgactccctcggaaggtagacatccgcattgaaactaattggtaggttactcggtttcctatataggcaatcagaggagccatgttacaatcgggtttggtcccaggctgtatatacgagcttttacaacccctcgactcaacctcaaacaaacgtttccaggtgggcttactcggcattgctcccgcggcaaagttatccgtaccggttcgactaaccgagtaatgcaacatgatgggtttcattgaactgtgatcatcatgacatttgcccagtaacagtaagtcctcccccgcttctggacctaaggcatccacagggcatacatttcaggcttagcagcaaaaacctttgtctaaggatcagaggaatcgtaccatctactgacacgatgcatcaagaattggcccttatgcggaagtagtaacgtttcgcggcaaaattctttctcgactttaagagcagaaactcgagcattaggcgggatagagcgtgaataaaagaagaacaaatgaatagctataactttcactgtgttttaaagcttaaaagcatttctattaatgctatctctaacccttcctctcttcgtattatactgccctacttgttcttttggatagctgcatataattgcagtgatctagccttgggtactaagaacacccaccacttcaatccacccctcttcaatgccgcgatagcattgtaacgagctcttcttgatacgtacgaccaaagtgctctggccaaggggctagtagtactcactgggttggtcggtatcttcgagcttggtgggctgaagtgcttggattggtatacgagaagccaggtaaaagaggcagcgttagtagtcattcgatgagccgctgtcctgacggcaagtgagttatccgtacgaagtttcatagaattttcctgccgtataaatacatcttgggcggactaggaaaggctatttttttaagctttcgtattcattgcgttgagttgtcgggccctggctgcttcattgttattaaactctattctctttctcttccgtgaaaaactatataagatcatgtgttaatacacagataatctagtataaggaggagacgcatgaacacttggtacgtagatagaatatcttagtcttaacctcgttatttcagctgattagacgtttcggaataaagaagccgttgcttccagccgaccttcgaaagatcaagtccgttcagagcttcacgtgactctctccgtgcggtcgagataccggtaaaaatgcatatatagttatcttctcctaacagatattcatacctgcttagttgaaaataaagtttagcaggaacactgctgaaatccccagccacagggataatctagtataagaggcttgattaattgtacccaaactcttatcgtttctgagaccaacacaactgaagtttgacaatctgcctgattcccgtgcggcatcaaaaacgctacaatcaaatgtctcagacgtgtcccggacgtcaaatttttccgtcacctttgcagtgccgttaagaaaggaatcgctgtacggtgttagccttggccaattattattggatgatcaagaatcggcggcctacaagaaattggctgttatgttggcaactattatcatggatgacatgtcgtcggttggccagtgccaaatagtctcgtcactactattctttataggagagagtagcagattatcatttgaattgatgctgagataaagattcttccatgactgtgccatagatggaagcctgagctgacggagttgagggttgtcgtacactatcacgcttgcaacttggttgaaagagagatccaagtcaatgacggcgctctgccttacatcaaaacgatgaacagtcaaattcttcagattctcgtggcgattgatggttgaaacgccagtcccaatctcaagaatgccttcaaactccattccttcagtttcaggaccactaaggtgagtgtcaactgacttttggcttggattgccatcgacggcattcgtgtccatccaaaagtcagatttcgaacagtgaagcggtgaaaatcgataaaggtattactagctccattattgtataagttgtaggggttcactggattctgaaaaaaattgtccaaggattccagccttccagtgtcgtggatgttgacgtatggtcctgagggtgttccatcgggcttaagaactcctctagatgtgaactccttaaatttatcgagctgcagctctatcaaactcggcgtattgagtgaaaaccctccgaagtaatctaggttggaaaaattgatgtgtgtaaggttgtaaggtgcgtataggctgatctcctggcggaccttgttgagtttagggaaatccagtttttcgactccccgataatagaaaaacctcaatgagccattgatacttctcaaagtagagctgcttatagtgaaggttgtggatgcgtccatgcaataatccagtccatgttgctttgtgggacacttatgagatacatctccctggacttcctctaggccatccaagttgcaggtttcgaagatgtccagatccagattcccagcaatcgtcttgcaattttctcgcacgttcttcgcatcttcgccattccggattgttatgttaccgtcgcagttgatctcggacgctgttactgcaaaaaaagagagaggctgtcaagtacattgtttctccacaaccaaattttggagcttcaagttctgtactgaccctgcgccactgcaaatagtagcagcataaccaatggccaacatttcaacatattgatgatgaaatgcggttttcatcagcaagcaatgcttggttgtaggctgtgagaaacgagtcgtggaaatattccgcttttaaggtatgggatcttcgggggggaattgaggaatggaggagatataagaagtatctagacgtcctccaaggcctcttacacgctcttcagaatctaaaagggccaacggcatctagaacggcgtttagacacttagcttcattttcaggttcactacctaatcaagaaatgagtggttgggatcgttattcacctatttcaacctgatgctgaagcagcccgcttcagcagtccatcagttcctggcaatcatgctagcctaatttgcaaagatatgagaaggatcaccattggtattccctcgattgagcattccagcattggtcctcttgtgctttatacttctgaatcctagagcttcatagtttcactgctgcttcgcggactcagaaattatgtctgctgccttgatacctagcatataaacggaggtaacaggaaacgcgcctggggtgtgggggaagactgaagcgtccacaatgcgcaggttcttgacgccattcacgcgaagctccgaatccacgcagtaatcggtgtttccctttggacccattctgcaagtagaactgcaatggtgcccaaaagcctcatctttgagattctggcgcaagtcaacaccctccccaggctggagtctcgtcaactggttgtaaggtgcgggagccgcatcccaagcgcgataggcaacttcagcgccctccacaagagaatccagatcacgctctccgatgtctccttgaagccaatcaaatacaatctcaggaacgtcgcgtggatccttggatcgaagagttacggtacccttcgcgtggtctccatccccaggttggtgtagcttgacgatatcccatgtgaatacggatggttgggggactgggttggagtagcctgggtagaagcctcggagctcgacaccggcaaagccgaaccagaattggtctgcctgttcagtctcactcacttgagagcggtattgaacggcaagtggagcggcggcctcaccgtatggtccagttccgctctcaagccactctatgtagcacgggtctgtttcgtcgagggtcatcgtgcatcgtgcgttaggatcgttctcccaaggcaccgatgatttaaccaatagaataccttcagtatggtcttggaggtacttgccctggaatataccgataagcaatcaactccaggcttgagtctaagaggtacttaccactgcgggtaaatctgcaaccactgggatgttgaatttctctagttcttcccgagggccaatgccactcagtttcagaatttgtggagtgttgaaagcgcctccagccacaatgacctccttcgaagcaaatacttgtcgtaggatcccagcctgatcgggactgtagcgcttgtccgcgccataaagaccttcgccgaccagatattcgacaccaattgccgtgggaataccattctttttctcatcaaagagaattcgggtcgcaagggaatgagtgctgattgtgagagggtaagcagccgagccattttcagctttggcattggccgtatctatgatgaagtccctagacccagatcgtcttcgcatgccggtggtgctcacaaccagctggtaaacacctggtgtgtaagtattttcgccgttgacatcgcgtcgcaacaggtcgcctaagccttctgtgtctacttcaacaccttctatttcgcgtgctagattggacatgacgtctctggtccctggtcgacctgttatataagtcacattattttggttggactttgaaacgagtgtcagtatttacggctggcgatccggggtaactattcgagatcttaccgaaattataccgtcgaaaccatggtttggtgaaccttctggaagatattgaactctttccatgcgctcgaaatattcttccatagccgatgctgcccaggactcatctcctgtgagctgcgcaaggtagtcccactgcgattttcagaggttatcaaagtatccggttaggggctaattgggattcacggcagacttacatcgacattgcgtggcttgatgaagttcatggcattggtctggctgcttccacctaaagtagctccacgaggatagagagtaccgagactggtggcatttgattagacatacgggagatgaagcgggaggttttagaacgtgaaatacagacagatagactcacggtgtagcattgggcggagggtcaagcccatagtagatcgagccattttcaagacggtaggaaaacttgctgtccctgcgaccttgtgtctcgttcgcgtaatggcggatatagaagttccaggacatttcgggatcttcccctgacgtaggccacctgccaaatcataatcatcagttgtcaatttatccttaaaacctgctaagaattataggcgattactcacaaggctggaatttgctggctaacagctgtcccatgatctcctccggcttcaattaggaagaccgagtgccctttccgagcaagacttgcactatcaaagaaattcttgtcagctgtttttgaaaagttgtgaacgatcaggtcttgcaaatcatacgccaaagttcctcctccagcaccagatccaataatgacatagtcatggacggtagtatcatttttggtatcaccagcaggcaaggctgataacggtgttgggaaaagcgcccaagccaggactgaggccagcctgaaatagcgatgtgttaacattttgaacttctgattcttcgatataattcaaaatcaatagctaagaaaatcagatttttgatatttaggacaactgaactatgcaacaacttctggccgttatatagtacacgctctgaggagaccattccggcttgggcggctatagtcaacgatgatcctgggctttggaaaggttctacctagatccatcggtcctggagtttcggaactcgtaagcagccccggacttagaaatgattctggagaagcgattctggagttacaacttagagttatgcggcatatccggaattaacgtctcctagacattgataacctaatttggcaaatgatctcgtcttggcgaaaaccagggtggccctcgcataatacagacaaacttggtagtcagactctgttgtggatatcaagtttggccaaacgtggaaagaatgtcattcaagcacagaagtaatgcaacatttcccgggagccctggtcttacgtttcaaggtcagatttacacggccaaataattttctttgccgcgcggagcttccacgtcactgtactctatctaagcaatctattatttacgatgaagatttgtcatacggcatgcatagatcctggaaacttctctacaaccttggttccatctaggctctataggctggtatagcccgccgcaaaactccgcagcgcaaaagcgagcccagtcgccgtctgtctccccattgttagctgcagctgatcgatacggatgagagagtttgagttcgaagtaaaaaacagccatggaagactccagaaccggcgcctcaacgcaatgaatacgaaaccctaaccaacatcagcatcagcatcagcaagcacaatatccaaagctacagcagcagcatcaagagaagtagcagcatcaatcacaacagctgagcggtaagttaacaaccaccgctcatgtttaaagccactatagaggtctaactaatgtttgtcccagcgtggtgtttcgaacaacaggtcaattgatccgaaccacggtggttaaatccggccctactgccaggtaagcaagcttctaaagagttgtagcgtatacataagtatttaaataatcaagaagctaacaaacattctcttcatagtgaagatggcgacttccccgccaccaccactaccaaaacgactaccaccgcctcccaggccacccccccgagcacaaccacgatcacagccgtggtatgggaggtcgccgtccaccaggacaccgaggcgattttctggtgttttgcttttgttatagccgtcattttcgccgtggggtatgtcgggtggctgctcaagtagcgcccgtgtttacagttgttttgtttactattatgttatagtaagcagaaaatgccgcctgacgatgactcaataatttttattattcttattgttaactacctattatctttcaatattgtggcctctaattaaaggttaggatgaaacaacctgtgcaggccctattactagtctaacacccacttgcctggatcaggcccgtccctgcaagacaaatgatgaccatgaaccagagggtcttttgactatgatgcgtttacccgtacgtatcgcacttgactgagccaacgatgcagatcacttcttcaccacgttcatcgattaagaggcaatttcgctaatccgtaggctggttataacgccatcaggtctacagctcgtagggatagccctgcatctccttgaagcagcgtaagctacagcgatgtatttccccacttttattaaaagcctcaagccgtgacctcgggctacgcgtagcaacgcaagaagccttcgctagtaaattactatggcaagcattcctccctatcctgacccggctgatacagcagtatataaggtttctaatgatatataattatatatccgggttaatgaagcgtaatacgagcagccggttaactgtacctatcgccctgatatcccagaagctgataaatacagtatatattttcaacccttcctaattagccctccttataaactatatattatacagctactattaatacccttattactattccaggtatttatacctctttatctagctaatttatagactagctatataaattataaccttctagctgatcaggtagatagttaagctgggcttataatatacctttaaaaacagatctcttagagctatactaatatattcgaaagtaagctaatagtaaagatagctaggctattacttctaactaggtatatcttttactcgggatcttaatttatataggaaattatactaaaaagtatatctaagactattagagtacttctaagctgggtaatataaagctaatctaccctattatataatttataagctataagacctttaaatagctatattataccttctgatcttatagcctgaggggctcttataagagctcttttaactgggtttataagtagttagagctaatataataagcctctctttaatactggattcctagtataaatatagctatagataaatatatttagtactttaagagcagaatacttaagaaagtaattattaaatttaagcctatacttaaagggtttaaaatctaggctatagctaaagctagctatttcctcttatagctgctatacctaccttataaggtatttaactctattagtaataataagccttaaataagaaagaggaagagagataataaatatagccttaatctaatataagctatagtaattagcctagtaaaacagctactactagctatttattatatcttcttagataatctctttttaagtccggatctctttatagttttaagagatttaaatattagggctataggtatatactatataaactgcagtatctttaaataccttatatagctaaaaaagactaataataataggcagctgaagtagaattaggatcagatagagatagttctaatactagataataaggttaattaagctagaaattccctccctagtaattcccctactaatagctttctagattaattaaattacttagaaagataatactgttgaaattacagtggccttcaaggtgtattgggccttgagaccgctataacgcagcagggaagttcgctagaggcgccacttctgcttcccggcgggcgaattcgtccacctcgactggtggttgtagtcctgcgacccttgcgcgggaacgctcttctgcgtgttgctgcgtgatagctgcaattgtctgcctaagttcatcttccggtaccgtgatggtgtcgtgccgggccgctgctcccgcttggtgggcccgatcggcggcgcactggtgttcaatccgaccccatgcgcgtttctgagcgggtctctgagataccagctgcctggcgacagtggagtgcggcgtttcctgtcttcggcgggcctgtgcttcagcgtgttctcggtccagacagtccatttgttggcgaatctcatcaagggggaccctcaacggctcctcacgggacgtagccccagcccgttgcgattctccttgtctccgtcgggtacgctcttgggcacgtcggctatcgaggtggtccaccgtgcgtcgcacttcgtctagcggaaccctaacggtctcttgacggggtcgatgggtgccctgatgtgcccgggagcttgaagcgatcgagtaggaccgcccgggcgtttgtcggcgtccgtctcgaatgcgtccgccatcgagatcttctaccaagcggcgaatttcatccattggaactctgaccggctcttggcgaggcatcatggaatatcgtggacggtgttgatcgcataagcgtgtgcacgaggggcgagaaaagaagaaaaggggaaagagaggaggcaagtatagacggccatgcttcgtatgaaggaagggtggcctggatgagggggccagagacgaaggtgacacaggagacgtcgcgagtagtgtggcgacctggccgccttgtttcagaccgcaccatcgtagagaccatgataaatcgcgaggggatacctaaagccaagcaacacagtcgcgtgaagctatctagagctttaatgacatacaagctcaacccaaacgtgatctttttcaaggggtgccctaacgatgaaaggggggagaatagatagaaacagaacataggaaacacacggatgcaagtcggccttgacggggcctagactagatatttcctatttcctttttttttcttccctaggaagtcctttccttccctttcccctctgccagcgtgaggaagcgagggtcgagagccggtggcgcctgtggctactgagatgtggctcaacaaactagaaaagaggctcaaagtggctgaagctccatggggcttagaaaagctcagctcgccgagcgagccgtgcgtggaggggggaaggagggcgcggaaggagggcgcggaaggaagaacctttcggaactacgttccttcaggcactacgttccttcaggcacaggagaccggtcccctccggggcccgccaatgcctgaaggaacgaagcacacatgcaccaccttcggtggcgcatcaaatgtggctccctcagacgtggctcctcggatgtggctcatgaactcctcggatgtggctcatgaatgatggcgcatgaaaaggggcttagaaaagctcagattgccgagcgagctgtgcgtggagggggaaggagggcgcggaaggaagaacctttcggaactacgttccttcaggcactacgttccttcaggcattggttgctgtgctgaagcgcgtacgatttgccaagtttacgcgagcttgcagtatggccgccctttcccccctcatcatagcagatcgggtcaaccgttcaatgtgaggtgtgtcgcgagcggatgtaaggcggaaattagagaagcggcatttggatgacgtaagtgcatagtagaatgtactctgtacctgctgcgatgtcccaatatttagtcgcatttcgttggccttggtcgcagctggtcgcattcaatcgtatttgattgtatatagctgcatttaatcgcatttgatcgctggtgcttattgcacaggttaaaggtattggtgtgatggttgattacttcctaaaactgggctcggcgggggttgagttgagtcccaattcttggtagcgcggccaaaccacgggtcgaggtgccaagattttaaatcgaagccaagtcttaggtacatcgaacacagcatatcttaattaaggcctgattgtacatgtgtacttatggactaagccattgtccgggctacaggtcaacaaattggggagtgaccctatcaataccacaaggaagctagaagccacattggtgcgtatgatgtggaccttggtgtctcagcctttcagacgtacgaccggccgtccgtccatcgaagcctccaaggatctattttctgctttcgtgtctcatccctgcgtgggtcgccaacaacttcgcgtccattttctgctcctcgtgtccaattccccttcccaattagtattaggcctaatatccaaggcttatatgagccttttgtgtatctttcgctctcagcatttcttaattactcctggtcgtttcattgacctggccgaccttttcggccttttcgcagcagcgtctcactgggttcatccgcccttacacatcgcttacagatatcaatagctcgtccctagacatagagctggtcatgaacaagcacagataaataaaagaacgccttaattatagaaagtcactctagatatctaggtagaagtactattaccatcctcctttatagtatagtcggccggcggttttctcacagggcgtgggaatgatcttccctttgtcaaagaaaataataagtaagccgtagggattgacatttcattaggctacttacaatctcgtcaatagaggccgggaacgatgagtcgctggcagagttatactcataatacctgttattccgacgcacaaggagataaacatcaaagttaccccgaaggctaatcttgtcgcatctacgtattagccgctctattgtcctggtgagattctcatttgagcgatctctcttagcaggtagcggcttatgttccatagtcttgttttccttttggggaagaattagttagttagcaatttggtatccaaggttgaattgctagatttgatagctgcgaggaaggaggagggcgagcccggtgttatttaaccccgactcagggcctgttctgggctggtaccagttctaggaccatacggaggacgatttcaaaagtaatgtctcacgccaagaaacctcgctaagctagaaatagaatagttacactaaattaacagggggggattcccggccctccttgtattcgtttcctccctcaagacgaataacctcttggatgtaacgagggattcgttcaatccacctctgaatagtctcttgcgggaggttcttccaagcagccttccaagcagctagggctacgagccttgactttggagaccctttagaagtagtcatcctcttcatctaagcccacgccggttcgattatattaagatctgggctattagcacaccacagcagtcgcttaatctgatgaagattatagatctgttgttgaatatagtggttataactcggagccttatcttcctgaacaactgtagctggccgggctagctgatattcctttgcaaaaggaagcagcttcgggttcaagatctcagtctgatagcgataccagttaatccctcccttcttgctgcgggccaacttgccggtcttttggttctatctccattgaggcttctgacccggctttgtatgaagcctaagtcgttgaattcctgaatttagctcccaaatctgctgtatctcgggttctaattccttattcatagcttcaatttccttctcagcttctctcttttgagccgtggtctcaggagcctagcagtggcaagggcctttacgatcgtatgaaaaacagccccaaaacataaactctgatgatcccttctatctcttgcgaataacactccttgcaaaagcctcctctttcgtccgccacacacgataggctcctcggcgatgtaacaagataacagacgttttatctgaccaaattacattcttccaatcctcgagggtccaatgctggtgggctaaacaccagtcaagccgttccttcctcatcctcttcgtcaacccaggcttcctcgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagcagcttctggcgaggctacaggtggtctgccggagcgagcagcatcctcaaagtaggagtctttgatcgtcagctagcttgcatttggctcgaagccgcgttcaatagctttggcatagatccggtcgattgtacgggttggaaccccggttaaagaagagatttcccgactgctaagccggctcgtggctttcaacgccacgatatatgctcttgttgagatatcatacannnnnnnnnnnnnnnnnnnnnnnnnnnnnnnnnnnnnnnnnnnnnnnnnnttcccgactgctaagccggctcgtggctttcaacgccacgatatatgctcttgttgagatatcatacatctcaaacggcctcaaacggctgcgttattgtacagcagctgctgttggaaaaagcaaaaataataccgcatggaggttgtccagggagggggctttttaggtgtgaaattggccctaagtgggacactaatgatattagcggcttggcgagacattacttttgaaatcgtcctccgtagagctccatgatcttggcacacctagtcagacgaactaacccctgtacctacagtgtgtgatttatatgtacacccccttcgttacacagcaaccaacatcttagcgccctgcaaatctttacgcgactacctaagcgctctagttagccattttacgtcatgggttgccagaaaattttagcgctgtgcaaaactgttttctgtgaatggagcatgttgctagcaacctacacgctctagagcaacctcagcttccctgttttccgtaggttgctggcaacgtcagctttcctgattgctgctttctgtaggttgctggcaacctcagctcccctgacccccgcaggttgctggcaacctcagctttttctgatttccggagggtcgctggcgacccttagttttcctgacttctgatctctggagggttgctggcgacccttaattttcctgacttctgatctctggagggttgctggcgacccttagttttcctgacctctgatctctggtttctagagggtcgctggcgaccatgagttttcctgacccctgatctctggtttctagagggtcgctggcgaccatgagttttcctgatctctgagggttgctggcaaccttagcatcctgggctatattccagctctccccagctagtgtcttgtttaaagtgctagaatatgaaggcatgattccactcgcagtgattatatccaccaaacgacgcgggcccttgtattgctgctcagctgcccaatctgtgtacggcacacctttacggagacacatcattggactatagaacgagactatctgccctgaaaactcagtccattcaatactgctgatgttctctcgtcgttcatcaagccactgatccaaaaggctaggatcctgcacaaacgatcgataaagatccccatagtctataaacagtacttcatcatcttgaaagtgtctgattctgggcattgactgggctgcgtctgtgaagttgtaaccccgtttctggtactttttgatgcctttttggatttttttactcttctttcgttgccaaagtacagccttcttgtcttttgcctggcgatagtacatatggcttgcacaccaaccaccgatgaagcattggacatgggtggcgtagaagtccttgaccatactcaaacagcttctgatgcctgagtaatagcaaccaatcatcaattggacaggttctgtcccagtagctccctgaattgttccgcgtatgatgctgaagggctgtcccaagacgtctatatagtctgctgtttctggctgtggtctgaattgatgcgggtgaagctgaaccagtattttgttgtctgaacctagggttatggtgcagctatcatagcaggagtagtttattttatagtcctggaaagcctttaggatttgttgcaatcgaggactgaaaacatccgggtattcttctagccacgaggaaagagtgtagagtacttgacatctgagcgttattgtgccactggtctccagccctcgttgagccaggcaaaagcgctggcctacctatgaacctcgttgcaagatccctggacgtgagcaggcctgtgggagtctctgtcaaatctctgatgagcataatcggcgaagcgggcgacgagaccaatcaaccaacaccaaaaacatgaggattgtcacaggtttagaaggctaggaagatgaatagatttcctataggtactgtaatttggaggctgctatggtccaggccagtttcctctcctcttattcctcatcaatgcactaggtgcacataacatcgacatggaaattctcgccccagcgtacgggattgcgatcacccatggtgatcgatgaggtttctttgagcaattgccgcctgtgggcgagaagtgagtgaggccagaggatgtttcgaattgcatgttgggtattatcaccccggcactttaatgggcgttgattggtttagagatgcatttccaagcggacagggtgcaagctcagcaaacgaagccttgcatggctcagatagccattcctcgacgtcctcttctcagatgtcaccaatctcctctacctcattcccacttactcttgagtactttgcagccatggcaggggagttgacaaatttatttcgcaagaggtccagcacaaaatttaacttttttttcaactctatttcaacttaaaataagaaggtgaaaagaaagtattaaagagccaaaatagagaaatactagggaaaaaaagaaaaaaagaaagaaaataaaggggagaaaaagagaagaagacgggtagtaagtagctataaatatacgagcactagattatctttatagattccccctttgctcctgttcccgctcaatcgcttcaaaaagagacttgaaattaccagcaccaaagccctcaaagttattacgctgaatgatttcaataaaagttgttggccggtcaataagtggtttggtgaacagctgaaggaggtagccaccttcgtcataatcaatcaagatgttgagatgttcgattgtgttcagatcctcttggagctcccagctgcggttctcagttcggaggcgctctcgcaccgtgtcatagtaggatttgggaatgctgataaactcaacgccccgagtacgtaacgcagtgatgcaggaaatgatatcctcagtaaggagtgcgatatgctgaactccgggacctgaattgaaggtcacgaactcttctatttgtgacttcttcttggctggtgctggctcgttgatgggcatcttgaccttgttatttgcggatgccattacgatggagctcagtgcagaatattcagtgctgatctggttgtcgtccaccgaccagaagcggtgaaagccaaggcacttttcgtaaaaagcgcaagcctttgtcatttcgttccagtcttgattaccaacacaatgatcaattcgtaacagcggtacatgaggaagttcaagttccgacgacagctccttggtgactgcacgaaaaccaggcaagaatggcccagaatattgctggcgatttatgagcgtatgggtcgtgtcgccatacgtccggattgttgctgtgatggtgctgccaagcagcttgtctgaggttactgaaggaggttgaacagctatggccgcttcgttcatgatggcaaagttgtagatacccgcaacatcgtccacctcaaaggcaacgtccttgacggcatcgccatgtttctccaagtgatcatgcatttctcggagtagggccttgtcactcttgctgataggctcaccgtctggcaaatgtgcagcagagcgaagaggtgaagtcaaaatgaaacgaatgtcttcgtttgccacgacatatgaggcgaaataacgcgaatctgtctccagaccacgatatgcaatagctttgaaaccaaagagctgcgtatagtagacagcggcctgtttggcgttgcctacccaccaggtaacatgatcatagctggagaatccgccaggcgcctctctttcaagttggggtccatcaacctccaaagaagggatgatttggccgtgggtcataggcaccggggtctgagggatagccgaagaagccattgctaaatgatgtctacttctttctagcgggaatcgagtgtgagtaagcgttgctgactgacaaatagatgcccaatcttactgttggattatgcaaaaagagtgtgtcaggcgcttggaaaaggctttggtgttgcggccgaacgcgtacaaaagatggcaagaacaagagagacgatgaagggctttgtgttgatcagtggagctttctccttatttgatgattgtccaaggcgagatcccttttttatttggatggttctctttggcttaaaactattcggacaaggtcacaggaacacagtttccctttttatagtagctcgatgagcttttgacaggctgaaatgagtgaattagtgaatgctgagatggaggtgtctgccgtgcaggtaagcatttgtgatccctccgcccttcaagtcatttccgctgtgacaaattacaaatcaggacggccgcctcccaactcaatttgagtccctgctaactgggtagctggcacaagcgaccactccattccgcacgcacggcgacacctaaaaccacatgggacgtcgtcctccatctttttagagaaggaggcttgcagatacagctggtcgggaccctgagaggccctgatgcctgaaccctgttttgtcctggcggccatgagacaagtcatctatcggccagccttaccatctcgcgagtccgtagagcgaggagggcagctcagcgggcgcccaaactctagcagtcgggagatggctttattacgctgatcgccggccgtgcaaaggaacatgtcgaatcgggtattcaccttgacgatgtagactgacatgttttagcttttttggcggggagcgggcctgcaagctcctaaagttaaaatcgatgataccatgattgagatcctatgatcgagatcctatggtatggtcgagatcagataacctaggcattgaatttggtccggcttgactacccaagtgccagcagatgatgtgttacttttccatcatcacatgagaatacacccctgcagcgaccattcaacaatcccgcaagactcaccatggcttttattgtctttctcctaatgacgcctatgaatcttttgaacaaatgctgctggctagaggaatgtctgagaaacattccaatttgtccccgctggaaatagagcacaccctgggacatggtggtcgaggccacaacaaaaagggagcgttaagagttgtgtcttagacacactcaaggacggtagaagatggtaaaaagaagacatgcatgattaggcatcgcgatgtggttttaatctcacgacatctgcaagtccattctgaattcatcttgaacgggtgactcggaaattccgcaaacatgtccaggggtagaagcacagcaacttcccatgaaaacagcatcaggagcttcatacaaggggtgacgaaaacagcacccgacttattgcagtgtctccccccggaagcggtcgttgacttgagaagaaacttttggaatattttctaaccatataaatgattagctccgcagcttgactccctagtgttctccctaacctcgtcatatttgcaacatcggctttccaaagttggcaaagtcgcaattgagaaagatattggcgtctggacttgctccaatcacaatcatggtcagatttgcaacacgtcatgtcctggcagcaacgctgggcgctgctgctgcggcaactatacgagaagcgcaaaatgacctcggcgctctagctgatagcttgaagtttcgaggcagcgtctacgccacctattcggcggttctgccgcgtgccatacaggcgtacgataccatatcggcgctggtaaatgacactagtctggcgccacaagcacccacgatccggagcagcctcgcccgactcatcaccgagagcagctactttgtcaccgaatcattgcagccgggctttgagcccgaccctctagaatcggacagctatctaacggctagtgtcactgaatggagctataccgtcaaggtgctcggcaacaacatcgcaacacccgtttgcgacatccgctccaacctgcctcctgcccaggcttgcaccatttcatccgacgccgcacccggcacagagtttcgggataatgctctgacgccgagaatgattgtcattcctacggggtccttcacggctggcgcaaccgacgacgaacacgtgcgctgggatattgacgagggcaagaagccattcgagataccccagcgacaggtgtccatctcaaagaaactagcattcagcgtcaccgaagttaccgtggcagagtttgatgcctttatccaagctacctgctatcagctacgcaagggggcgcgctggtggaatccccagaatgtttcccagttcgtcttcaacgacgccctgtcctaccgcaaccccggcttcccccagggccctgatcatccggtagtggccatcacgcgctacgacgcccaggcctacgcgcggtggctctcggccatcactggagccgtctaccggctgcccaacgaagatgaatgggagtgggcagcacgcggtggcacccagaccaccttcttttggggtaacgatctcccccctgctgccgagtatgccaatacgtacgacgacaccgcggcggcagtcaaccgcttccgctggccgtcgaaccacctggtcgaccctttcccctacacggctccggtagcatcgttcaagcccaacggctacggtctctacgacgtgatcggaaacgccagagagtttacggctgatgactggcaaaagaacctcagcacggcggctagggatgggtcaatccacaagggacctgcgccgtttccggtcgtgcgtggtggagcatggaactacaacccagacaacctgcgcatcaactaccggagtggctacctttccagcgaggttgctaccaacatgtttggcatccgcctagtgagagacttgtaatgcctgcccgaagcggagggcatgcatgtcttgtctcgggatacattggctgggtgtgtgggttgtggcagggtaaattttagtttagttattatttcgtcgtaataaccaaagttcactacaccatattgtgctcgagaaaagaattgagatagtaatgtgagtttttttaaaaaaaaaataaaaataaaaataaaataaaaaaaaggaataaaggggtgggggagcaaacccgggacagtaaaaagcaactaagtccatatccgacacttcatggtttgatgggacaaaagatcttctccaaagctcaatacaaggttcgcgggcacagccaagcagaaaaagttagcagtaagccacatcaacacccgagatagattcgtgagacatcaccgcatcctactagtgaccccacaggaagccatgctttcattcctgtgcacgtcagatatcacttttgtcccaatacactggtgatagacttcatatgatatggctttgactttttcagctctcatttccctgccacatgcacattccggaaatcgacgtttcaagctcgaggaatgaagctaacctgatgcgtgacctgtgaggcctctttctgattcaccttgtaaatcgactctctcagtcatcgccgatcagatcagattacggcccgtaggcgagcaaggaagccgcagcacaaaggatgggtcaaaagaaagctcgggggataatttacctgcttttctagcagaatcacaccatctatcagtttcattgcaccctacagatacggcgtattgcggtcgtcttgttgcaatcagaaactgtgggagcttctctttagttcatacgcgcctcgatgtcaaatcacgtcaacacagaccccgttgccagcgatgagggtaccgtgacaccgggatctcaagactcgcaagcaggcttgaaagatgctgatatctcttacagctcaagtcatgttatgcagcatcgggattcgcttttcgaggtgaccttggacgaaaatgacccaagttgcccccaaggctggtcagccttgtatcgtgcttgggtggtggggacggtgtccttctcagcctgggtagttgtcttatacagcacaagctacatgagctctgcccctggtctccagtccgagtttggggcgtcttccatggaggcaaccttgggaatgacaacttatctaatgggactcgcccttggtagcctctttagcgccccgttcagcgagatgtacgggagacgaattatttatcttggctctctgtttgtgtggaatctcctgataatcccctgcggtctggcggtttcaatgtgcgccatactggtgtcccgattttgggggtgagcggaaatttttgaacagaacatcctttttgccctggctaattgacgataacctctagtggagtctttgctgctgctctcgtgtcaaatggcccaggaagcattgtcgatgtgtcaaggccagaccagcttgctctaggcatgtcgctctatagcctaggaccattcagtgggccagtgcttggtccccttattggaggcgtcgttttcgagcacttgggacggcaatggacaagttggattgtgctcatacttggtggtttggcatttctaatgatgctcacaatccgggagacttacgtgcccgagttggtacggcgaaagacgaaacagctacgcagccaaacaacggaccaacgttggtggtgccagcatgacggcaaggagtcagctttggattcggccaaggtgaagatctgccgcccaataattttgttcttcactgaaccgacggtttggttcatcaacatctggtatggtggatcactcactcactcttcatcattctccgatgacttgccttgtttcatccgactggctgaatctaactaagctgataggaatgctgtgatatacggcatactctatctttgttttgtcgcatatccgatcgtgttctcgcaacaccgtggctggggtcccactagctcaggtatgtcttacctaggcattggcattggcatacttcttgccattgttgctgaaccattaattcgacgaatcataaactcggggcccaaggaccccgtaagcggaaagccgcagcctgaaaacattgcagccatcatggcagttggatcattacttagtcctttgggccagtttggatttgcatggacatgtttgccggcaagaatacattggattgtgccaatgctgttcggcatcccattcggtgccggcaatactcttagtttcatttattcaaacagctacctcggacgagcgtacggcatttatgcagccagcgcgcttgctagcaatgcagtgatacgcagcattttcggcgccacgttgcctttgatagcaactcgcatgtacgttgcagtatcgccccagatagccggcaccatatgtggcgtactgttgctactcatgattccgattccttttgttttctggcggtacggccctcgctttcgggagagaagtaaggttatcaggcaggttggtatatgaaatagcatcaagttaaaatatacgagtcatctaaacgctatcctcttattgatttcgatcctgatcctactgctttctgtatcacttattgcccctgaattcttttagaaaaaaaaaaaaaaaagggactgagtccctggaccataaagcagtcgtgggccatacagtacaatagagctattgatgaaactatttaaccaaaaaccccttgtaaatttaatctacatgttgattccgtcgacttctactttcattgtggaaatcacttcgcaagcttccaagatgagctatccgtccaatgccaactgaatcgttacattgagtcttcttacaacgggattatataggtttgggcacggtatgattcgatactgaacaactcctcccaaaaacgaaatgccatgtatgagaatacccgacatctttagggagtatttattactctacttgaactaaactcagatatggctgttgggagctaaatactctgcaggcacttttggccatttatcaactgcgtcttgaatgatcatcgacattccaccagccatgtgattcgcgatatggcaatgcagcagccaagcaccaggatcaatggcgtgatagcgtatagcaatccacgctgggacaccatccctggctcctggcgatgtccacgtgtcccttctgggaggattgttgaaattgaacagttgaggcctctcgttggctgctgcttcgaccgatggccatctgaaaggaccggtaccacttccgagttgatggatcttattgccgtgcttgtggataggatgtggcgggaagggagtttcatttgcgacaaagatcagatcaatccattcgccgaagcgggtcgtgatagtaacgttgttgttagcctccgggtgtggattaaacaagatgggtgtctcgtcctcaaagtcttcaggcatgagtctggtagtgttcatcgcccagagatatgtcacatcatcctctatcatgttaaggatgaatgtttggttcgcagcccgtgggatccgtttgggtgggatcgggaacggcgcggccgttgtctcattgaaaaacttcacgccgggcgaagctgcggccccgaccaaattgatataagggctcgcctcaaccacgtcaagagatccgcccacagagagcaacgcgtggcccgtgattatttgacctacgctcaatgcgtgaacgcggatcttgaaggctcccggttgattcgtcttgacgagaaccgagaaacggtcaccactgccgaggactaaagcttgaaccttttgtggttggacgtaaggtccatccatggcatacacccacatgtcatgtccgtcaattgagatggcacctcgaacgaggttcattgcgccaatgaggtcaatcgccacccagcgctcctctggccaaggagaatttcgggccttgatgacctctttcgctcccttggtaggattacatccggagaagataccgtcggggatggcgctttcattgactgggacattggaaccgccaaacaggttggtaaccacttttggaggcaggcagctaacagtgaagacgaggttagcaaagttgaacatcaataatgatggagctggcttaccccttgtctgttaacacggatcctggtacggtgtcaagatttgtgcgttgtattgtacccatttgctttgccaaaacatctggtcccaagcattcgacgttgcccttaccattaaaaagaagggcgtcatagcaaggaatctcaatcctggccgcgtgagtgaggtcttgtttggcggttgaggtaaggcgcgtccaatcagtaataagcaatggttggacctcacgctctgccttgatcatagcgtttaccgccttggtgtcgttggagatgagattgaatggcttcggatcgttttgcctgggatggatgacgatagcacctgtcaagccatcctcgatctgtgctcggtaatgcgcgtgataccagtaactgccctgttgcttcgcttggaacttgtaggtgaatctctctcgaggctgaatggcgcgctgagaaattcccggcacgccatcagaccaaggggtatcagacatctcgagacctatgacgataatttagagccacggttgacgaagggtcttttgatggtgcctaccgtgaaaatgaatgctgatattgtgaggggattggttctgagttcgaatgataaccaggtcatcttgatctacctcgatggtaggccctggcgaaaggttattgatcaagaacacttccctggaaatgcccactggagcatgactacccagggtaacattgaaatcgtattcctttgtaggaggtccattgtcaaacgcaatgctccctacagcccggtacagagtcaagagcaggatgagtacaagttgataacccatagctacgtagtcgaagctgtgcagggaaaggttgtctgagtatgtggcacactttcatcccaaggaccaaagaagaaatattggtcattttgtatctcatggcttagtacatttaggccctgatcctatgagcgcctaagtcgtgccaaagttggcattttggcataattttaatgctattccccttccatcgctagatttacataaaaactacagtatccataattcggcatccaatatccctgtaagcaaagtaccatactagtaggggccttaaagtggtcaaaaagtggcttagtagccaaggattcatacttattttgcttaaaatctgtgctgaattagctcttgaaaataggcatgccaacttagacatttgccagacatcatcggtgcatcagctaataccccactgggggatgtaccaatctttgtttggcatgccaacttaggcgctcataggatctgggcctaagttagtggcaggtcaaaaactggctgtactcagtgaacccgcgcgattcagagtgtaatggtaattgatagccggaaacagatcccacgtgagagatcaagtggtcatactaagtttgtaagtgcgttgtctaagccatttccaccaacaagcccagacattcatctcatttctacggagtacatgacttgggctaaagcccgtgggtttccgttttcattttaacttggctcatttttgacttatactagctcatagaaagaacaaacttaaaacatataaatcttactgagtagttgtagtctaagctcttcaaaatacacctaaatagtttttagtcatttttagctttgttcctttttttaccaatgaatgaatgaatgctcagatacccaggcactctactaccgaagggcctcgaacccatctcatattaagctaaggggcatactacaagatccttccgagtatcgcctcttaaacttcaacaggtaaaaacttgtatacctgcttgccttggtacggcggaattgtcagatactacctactgctagtcacctagcaagttgttcggggtgcagggggcttttgaaagcaagagtaccaccacatatttaggaaacaatagtcaaaaaaattttgattttgtactttccctcttcctttgtaataccaagtctcagtgcgagggtcttctcggacatttcgtcgaacagccgttgccgaggggaccgagccccggtgaggcgagtctcctaatattcttatttagtatttatatggcacaccttatccctgaatggtattcttttggctctcgtcatggtcaaaaagacatttggtgggtgtcaaggttgattgttgtgtacggtatggatgaatgtagtaaggcatgattgatgccagcatgcagatcgatgtaattgtatgcatgatgacagctttcgtagagctgcagttgaatagagcatggtagatgacgagaatcaagcccatcggatacctaatttgattcctgagacatgtagaagccttatgagacaatccgaacatagatctgagacacttaactggcgggaccgatttgtctggggttgccaagggatctagcatggcggcatctaaccgaaatcaggcaaatgtggtgcagactccagtctccatcggatgtccaaggtgcggtcttgaacggaggcatacgccgacgccgaacacttgcccttcacaacgtcatcactgtatcaattttacaagatgatttgcatgttattaatcagcggatgctttgagaagctttcttaattgaacaggaaactgggggtgccagcttggcaaatcacgaaagccaagtttatagaatggcgagactcgtcttcataatcgcttgacttggcgtaatccttgttgtttcaaaatactccagcggttcgtcgcgagtgaagatggcggtggagtcacggagataaatctcttctccatcaccaaacaatcaccgccaaattcgctccgaccgacagcctcaccaagtgactgctcaagtcattcaatatctctcatccaggaaccacagagcgttttagctcgtcgtcctcatttcagcctggtgatggcttctaccacacgcccctcgagctgcgctactcctaccgcctcctctcccgcatctccaaccaccccctcctccgcctgctcctcctcttcctccgcgtcccgcgcttcttcccctgccgcctcccgccccggccccacgacatcatggcctaccccccgaggcctacatgaacccggacatctacgagacccgcctcatccccgcctggcgctggcgcgacaccctccagcgcgccttctaccgcctctacgagaccgtctgcgcctacgacgagcccttaacgggctacgaggccgagtacctctggaggcggagcgaccgaccagcgtggagaccggagatgctgcgcgatccccgcgacgacggctgcggcgaccgcgagcagctcgccgtcatggcctccctcgccgacgccctcaccgacgccttcaactggcgcctcgagctgggtctacggcccgacggcgagctcgtcgagggcgtccacatttgacatagcatgtggaaaagttaaagggagtttgtagcagcgtaggttgagctcaaatctaagagccataggtagctctgaacatgtcgctcgtctggtggactaggcaaaaggaatattcaccgtcaggcgggtcattttctgacgttccgataagcttcctgcgtcggccgcttcgttgcagattccgctctcggaatgttgaagaaagccaccaagccacattaaagcacattcagcttcagtttttggttggagggctcacgggtcatggatgatgatttcgcgacctcgggagtaaatgatggcccactggtcaatgagatggggttgagccagcgacagctgttaggaccaatcgttatcgtcaacaggagagaactcggtggcgacgtgctcatgatccagaaagacgactgcattccaaccctttgcaacatcggaatgtcagaaaatgacattttatgtcctctctcctacttagccacgtacggctgacttttcctccccctatctgtttttatcacactctctcgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtttgaccgatgtaatcgtagcggtttctagaccaggatgtattataacaggacaagaggtaattagtctttgccccacgtttataccaggcgtgctacatcgcggcggaagctaggagacttttggttctgtttcggatagcgtttgagtcggactggtattcccggtcgtcgctatagtatttgcctttatctgaagaattcaattttctctggataatttataacagcacccttcctttgggccctctatttttaaagccgaacgagggttgggatacgattcatactatgactaatgtatagcattccagcatattaacccgacatatgcaaatgcaggtctcgactgctattgactggggacgacaacgatctggactgctcaagagttcgtagttccaaaaagccgcctatagagacgtaggggtcttaacagagtctctggaggttttgccgctcggatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagggttaccctgtggcggtgatagacttcactcaatgcttgtgcccgctttctgattttgcaatggttctagttcgttgatagagtttgacgctgtggcgttgaggctaaagtctaatagcactttggcctaggatattaaccgggggcccgcttcaaaacagcccggagccttcgacccacataaagtaagagtcggaatgacgttacaggtagagcatttgatttgtccggtggtgcattacataatcggccaatattttgacagattttcttccccacgtgggccgatgcatggtttgtcggaaccacgtttgtcggaaccgcgtttgttggaacacgtaacgtttctgcttcatagcttaccgggtgctactttttctaatatcctttatttcttataaatgcgcatggattaccctcactctgacctggacatatctaatgtttgctcttcctgcatacccactacrtaatgtcaaatgccttatatgtgttcctggacttgcctgctgaagccatagagccgtttggtgagcttcgggaggatatcaaaagcatttcaccgaagaaaaaaaccaacgaagaggcagctatatatttatatggctgcccggaatcatacgcaaaattttcaatggtgtttgcccaagaaaaggtcagtactacagaaggcataccatttctcccgggctgattagatcaaggccgatgatataaagcaaatcttagccgatrcacagctgaaacctagtaagggccaatcaactaggccgtatgtatacggattagaccgtggtggcttccttacgaaattgggctttattgggctagcctttcttctctcgaacacaactcgcatttcaatcaaatccgagggaaatatacagacattagactggcacaccggctcgggtttactagttatgggagggacaacggtggtatttgaggaggcgaaagaaggcaatacggaggaaggcgagaacaggtttcggtattacttcataatgataccagttgaatccacttcctaagtagtgtcaaaaaaatttatcgggagttcgtcgtcgtatgtataatcttgggtcagacatgtcccagataaattcgccctcctgagtggcagtgcacatatcagccaaaaagagagatacttcaccaggactgatcgctctaactgcttcaaggctttcagtagaattcagcactggcgctgctgtaggcaccacagcaacacttctcggcgggcgtggtgctctagaattctcggtggggatacctagcatttcattctcaaatacattttcgactcgtagcccagagaaaagcagattaggtggttcttgaccctggttgtccgcgatatgaagtaactgcttaatggggggcaagaatcctcgctgcttatggctgtccgccgcgtcagggcaatccgaggtaacaacactacttgagttatcaacttccgttgtagagtcatcgaagtttgtcgtaatgccttgaaaggggacataatcctctccccggccagtctccccgctgctgccagtctgagtggccgtgtcctcgtggctggggaaggaatgctcgattgcattttgtacgctcatctcgtcggacggaagtctcaaagacgcctctgggcccctttcggcatcggcattggtaccaacgaaactcgatggagtaaatagcgggctaatctgatcgtgtggtgagcccgagtctctcgcaggactaacctcgtctgctctttggtttgtgagcccgtagttggtagtctgagtagcattgaattgagggatgttgttgttattcaacaaagtctccgcctcggccgaagtgggttgtgcctcaagaccactgttggtgttggcgccgcttgtcgcaaaaactaagctttcttcccttgcctggttcagacggcccgccgtgcagttgatggaaggcaactgaccctcctctggactggaggtttcatcgctgtttactagtcagaattgttgtccccacggtgcctattgacataaactaacaaacaaattgtaaaacagttattctgtaatatgtctggtttcaggttggactgaagcctcaagagtgcagacaacggtatttttccacactctaggccaagctctctcaaatttgtccggcgcttccgtacttcttccaggatattgtattgtccaagatcggcgatgttaagatctgcgaatgcttctctcggtctaagcgttatcagttattaacccatgactatttatgaagcgactcacgaaatatccataacatatatgatgaagaatgctgggtttagtacaagtgtatcttttggtataagaatctgcggaatctgctttttatttaatcccaccactcttcaataggggttcagccgataattgttgctccactttggtaaccaggagcaacttgcgtcatgccgcgatgatcctcccccccttgttctcctcattcatccatctccttcatctactttacaaaacgaagcttacgtcaaagtgataggatctcgcgatatgaagaatcattccgacgagaacgctgctgtttcggtagacacgcccaccacggattcttacgacccaacaatccacgaccagtgggatggatggtctgtcggggttccttagccaggcgagactttcatgattatcgagcgatctacgaaccgaacacttgttgaagataatgggcatctcttcttggaaccacgcgattcctgtgacgggcagagactttggcactgcgttatgactaagggtttcttcggttttcagaacaagaaaacgagcaaatacatcggctgcaatttgaagaacatccttcatgccaatgcctctgagcactcccattgggaatatatagtagcccataaacatccgaagggcgggtttcagcttctaatgccaacctggcgagggctcaaggtgatcggcattaattcagagggcaatggtcttatattgaggtctcacggcacgacaacttgggactttcttaagaatgattagttgatgaaaatgtatcttttctgcaataaatacgtctctgacttatggagcaactcaaatggatgtagatgctttctttcctcaaaagatttagcctcattatcatcgtcctcccctctttgtaatgtgggttaggcttcttgctggtgtaccataatcttggttggatgaaaggtgtgatgaagtatagctaactctctgacttgcgtacagattggagcataaccagcttctggccgcttgtatttatgtttcttgtttcacaatgggggtaccttgaaaatactttagagggttgccttcaatcccattaacaacttacagccatcccaccaatgtttcttgtaatggatgttggggtgcaacgtgtctaggcatggtggctggcgcccacacttggagcaatgtctaaaggagtggacaagaaccaggaaacggatacgtcataagctggtaacgctccggtttacgcccaggttggttagcaaaggaatgaaagtacccctaatgatggtagcccctgccgccctttacaatccacgccgaggggcgctgtgactctggcactgactcctctaattcctgctgaagcggctagaggggctgctggcgttctcgttcgacgacttcgaaggccgtattactggtcgctttcagtaacgcgggcgtacacgagattgcggcaggcctcaagatcctcatctagagttaccggtcgtgtgctttctcgttcctgattccgttcgatcgctgcttagtccctcttggtttctgctcgattggctcgttcctcctcttgtgtagctgtctcctctacctctcgtagacgctgaagcaacttttccgtgtacggcggggctctcatggcatcgtccgagagtgttaaaatcgaatactgggtcggccccagagaagcaaagttagtttagtattgatacaggctcaacatcaagagtgaaggggcaacagactacttaatggtgctagtagcgccgcgttgcctgtattaacatgtcgtgacttggccattaaggtcgctcctccagcgaccgtagattcacgtgggcactacttgaatccacaggatcccgatttcatagagcctggtggtttatttaaagaagggtggaaggtcaatagtgagtgctcataatcggtttgttgtgatgcgactaaagggaaaatagaaatgagatatcacaggtgccgcggaaatcgttggaccccaaagcgcgatcggtccgactgttgatccggcttcctctagcaggccaatcacatccgtcccagacatccaaatgagtgcattgtggttggtcaggttagttgctcgttgcgcatgcccattttggaaacgacgctttgccaacgacgctttgtgagactagaagctctatgaatctttacaatctttacgacgaaggccatggactatctggccgggaacgccgggcccgtggttcaagtcatgatacgcgaaatctgcgaccagattctgaagcagacgggtaaaacacacgaggacaccgtcaaagaaatcacgaaggcacacgagagaatcatcgagacgctatgggaggcctggcggaaggagcagcaggcactgaagcagatgatggcgaagcaggagaaagcaatggagcaactgcgataggacatccaaggcattcgagcccaatctgcgcaggagcgagagctgatgcagcagcaaaccccgcacgacgagatgaaaggcatccacgaccaactagacgcgatagctctacaactcacgaccagcccgacccagacgatacctaaagcccagcaacatcgtcgcgtgaatccatctagagctttaatgacatacgcgctcaaaacagaacatagaaaacacacggatgcaagtcggccttgacaagacaagatattttcctaccatttcccccccctaagaatccctttccttccctttcccctctgccagcgtgaggaaacgagggtcgagagcctgtggcgcctgtggctactgagatgtggctcaacaaactaggaaagaggctcaaagtggctgaagcatcatggggcttaggaaagctcagatcgccgagcgagccgtgcgtggagaagggaaggaggacgcggaaggaagaagtggaaggaagaagtggaaggaactacgttccttcaggcaaaactcaaggcaagaaattatattggggagcgcttagttgctggcaatttgaataccccagttaataggctcatgttagatatccaacctaagcgcccggacattctagtcaatgttttccggtcgcgagtaagtggtttctcagtacgtctccttgaatggctgctcgtgagattatataatcaattagtcacctgaccttatctgttccttatcggttatgatgtaccttatcgctttaccaaagcatcgagacatcgctcttacacgctagacatcattgctcctaggtcggtacttagtctacttcgaggtacttaagtatcggccattaatggatatttcaacatactgcaaatcagnttcatgttggatggtgtccctgattgaggcgtggtcgccgccccatccgtgaacgtttctccgcgcactggcacaaccgatcgcggtggcgtggtcatcccgcttatagattgtcgtgaatgcgagtctgatgatgcaactgaagataaggacgcgaaccctccctgtgaaggaacatcgaatggcgccgttgatgcttcgacagtatacccctcctggtatgcaggcataaacgatcttggtggtatcctgcctagagaattgtgtggggacaagtccgacgacgaagcagaagaaagagggaaggttgcctctggcagaggtgcatcgtactgttcaatttccgcctcaccactataagtctctctgcgcgtaggcacgaccgaccgtggtggtgtggtcatcccgcctatagagggacattgcgaaggtgtggtcaaatctgcagctgaggaaaatggaaagaccttttcatgtgaagagacctcgaaagatgttgctgctgcttccgaattttccactccacgtgaagccatggtagaccgggttggcagggccatctcacctctggaatttcgtgaaggcaggcctagcgacgcagctaagagtggtgtgggaacctcttctcgcggaatcacgccaagtaacgccacgggtgtctcgctcatataagtctccctacgcgcaggcacaaccgatcgcgggggtgtagccattccaacggagccctcttgttccaaaggctggcccggcgatgcagccggagaaaatggacaggttccctcttgtgggagcacattggaaggcgccgcgcacatgaacgtctccctacctgctggtacgaccgatcgaggcgggggggctatgccgttcacggagctgttccgtttggatggcgggcccgatgacgtaaccgaagaaaagggaaatatcccttcctgcgagagcaagttggagtgctcagttgccgcttcgcccgtaaacgttcctccacgcacaggcgcgactgatcgagacggggtgctcaacccgcttacggagttccccctttctgaaggcagacccgatgacacatctggggagaagggaaagactttatcttgtggaaatccattcgaccagctccttgttgctctgctagatggcatcaccgattgagacggcgctgcctcgcccacgacgctctgtcgtatgcgatctttgacaagtgttgaagcgcaacttcgattgtccggcgtctgttcaggtgccggcgaaccggaataggggctcgagtgagatatacggagccccgaggccatgtgttccaggctggcggccgtttgggggtgggttgtccgcaaggtttcgcgatgggcgtcttgggcagtctctctagtcggtgtattcagagggagggatcttctagatgccttgctattggtcttatccaggccatttgaattgcctcgcctacgtcgagccttcctgcgtcgtcgattaacatgcctacgggatgcccccttccttccttcttgggcggaatcgagacggcggctaagaccaggttcagcctcccctgtttcgtcgatgctctcgccgccgcatgcggggacagcagcgggttgggtttgcacgtcttccattactgtatcactgctggatgcatcgggttcatgttccacttcgatatccatcgcaccgctatcgcctctgggaaatgtgtagggttgatctggcagtgagataatttgcacgttgttgtttgattctatgcgatcatcgatactgaaagcaggagacgcctcgtcaatctcaaagcgacaaggcttgagaagacttcccaccaattcttggaagacagagagggcatctacctcggtggttttgtgattcataatctgaggaagaaaagccgactgctggagacgaaggaacacgctcgtaaacggccgaccccatcgattttccaccgtttgcaagaggttagctatttcctgctcctcgggctctaagccatgatgatacgatgggggcacggagacgtttacaatggggtgctcctctaggcgcacccggaatccaagaagctttgctcttttacgcaccaacgacagatatttccaccggtagagtgatctatgttcttgaaacctctcgtccaacgatttcccgttcgatggaggcgctctttttctaattacttttgttgactcgttgctgatgtatgcaaactctcgcagtatcgatacgagcagcacgttgaatgcgaggctgaacgaaggcgggcctctgacccgttgaaacaccccctcccgaacctcgaccactggttccgtctctgtccaactctccaggagaatggtggagagttctctctccttccctaagaggtcttctggcacgatgtgtttcgtgataatctgcgccgcggtgctcaagaagttcattttggcatgaaacgagcgaaagcctgggaacgtacccggcgcgttacacaccttttgagagatctcagctcgtcgaacaagcttggtgaccctactgaagacccgaccggaacagaagagttccttgatataccggcgatctgaagagctccgcggagagcgtccctcaagttcccggacagtctggagatcaaggtcgccatgatctgcccaggcgtgtttgagggccgccaacgactggatgatcatatcgtcaaggcccaacccaaagtatttcgtgaagcttgccaagtggagaccgtcaagtaatgggctccgcattagagaatcaaggatctgtctgatttccttgcgtttgatgatactctgaaagccctttagcctggaaggtcttaatctcgtttcccattctgcatagtcctttggctggcttctatagtcccgtagcttgcgatatatgtgcgcgtctgtaaatggggtttcgtgttgaaaccactcatgctccttgttaatcgccttgttcgagcgtaggccagacatcttggtcagccagatcttgaccatccagacctgagaggggtcgatggatctggccgccttgacgcgatgacggccgtggatataccagatagttcgcccatcgaggaacgagtgcagccctcgatggtttctggaccgtagctcctgagccgatagatttagctgttgtagaatcgactcggcctcggaatagtccacgtagccattcatccagttccggtcgtcatcgaagttgatgctggacttcctgaacacgctctcaagatgcccggcctggacctcgtcataccaacgttcaccattctcgtgtacgaaacgaaggcaagagacaggtacttcaaattccccaaagaatactttatcctgatgcatttcttcaaacatatctgcgggttgtgatatagaagatggtgattcaatgcaaaatcgctcatggctattgtgctcattttattcttaatattggtagtctagctgatttcgttttctgatctggtcaggttgtaggctgtcggcgactgtctctgtcccgttactctgtccctctgatagcccccagtactggttcctgttccctgtcacctgcttctaggagggttaaagttactggcaacctacctgaccaaagcagaaaccagaaaacgacaccggctggaggctggtagaatccatggcagctttggtccacaaaaacataaaacaaaagactgaaaactagacagtagccgccggcatctataggtacgggaagtagggaagctaaggtcgccaacagcctacaagaatcaggaaaactaaaagtcgccagcgaccctctagaaattagagattaggggtgaagactaaaagtcgctagcgaccttctggagactagggttaggaaaactaaaggtcgccagcgaccttctagagatcggggtcaggaaaactaaaggtcgccagcgaccctctagagattaggggtcaggaagactaaggtcgccagcgacttcaggaagactaaggtcgccagcgaccttctagagatcagggtcaggaaaactaaaggtcgccagcgaccttctggagatcaggggtcaggaagactaaggtcgccagcgaccttctggagatcaggggtcaggaagactaaggtcgccagcgaccttctggagatcaggggtcaggaagactaaggtcgccagcgaccctctagagatcaggggtcaggaagactaaaggtcgccagcgaccttctggagatcagggtcaggaaaactaaaggtcgccagcgaccttctggagatcaggggtcaggaagactaaaggtcgccagcgaccctccggaaatcggggatcagagattaggaaggctaaaggcccccagcaacctacctggcccaactacaccaggaaccagataacgaaagcattgaggatgaaagggtaggagatcggggaggctcaggccggggtggtctgttgaccctgaaaaaaaaaatcgtctgatgatgcgcgtccgccaacgatcatgtgagccaacgcagcaggatgttggtccgtctcatcaagtggtagttctcatcacctccgttacccttccgtcatatccaattaaaatgcttcgtcgggttggacgagaaatgccctggctgaacagagcggctacagagagctgtacgagttgtatgagcctttccagaggctagcaaccaacagcaccgacgagcaaccgagcggggctgcatgcataaaattttgctctcatcacaaaataagaggttcctttgattgaataaacccctgtcagttgccacactaagtacacgacttgcaggtatgccattcacgcttgtagccttcggggtccactttctctcctccccggtagggcaagtccccacagagatacagcaatcaggaaagctgaggctgctctaaagcgtgtagattgctagcaacatgctccattcacagaaaacagttttgcacagcgctaaaattttctggcaatccatgacgtaaaatggctaactagagcgcttaggtagtcgcgtaaagatttgcagggcgctaagatgttggttgctgtgtaacgaagggggtgtacatataaatcacacactgtaggtacaggggttggttcgtctggctaggtgtgccaagatcatggagctctatggtcctagaactggtaccagcccagaacaggccctgagtcggggttaaataccaccgggttcgccctcctccttcctcgcagccatcaaatttagcaattcaaccttgggtaccaaattgctaactaactagttctcccccaaaaggaaaacaaaactatggaacataagccgctacctgctaagagagatcgctcaaatgagaatctcaccaggacaatagagcggctaatacgtagatgcgacaagattagccttcggggtaactttgatgtttatctccttgtgcgtcggaataacaggtattacgagtataactctgccagcgactcatcgttcccggcctctattgacgagattgtaagtagcctaatgaaatgtcaatccctacggcttacttatttattttctttgacaaagggaagatcattcccacgccctgtgagaaagacgccggccgactatactataaaggaggatggtaatagtacttctatctagatatctagagtgactttctataattaaggcgttcttttatttatcnnnnnnnnnnnnnnnnnnnnnnnnnnnnnnnnnnnnnnnnnnnnnnnnnngttcttttatttatctgtgcttgttcatgaccagctctatgtctagggacgagctattgatatctgtaagcgatgtgtacataagagcggatgaacacagtgagacgctgctgccgaaaaggacggctaggtcaatgaaacgaccaggagtaattaagaaatgctgagagcgaatgatacacgaaaggctcgtataagccttggatattaggcctaatactaaatgggaaggggaagaggaattggacaagaggagcagaaaatggacgcgaagttgctggcgacccacgcagggatgagacaagaaagcagaaaatagatccttggaggcttcgatggacggacggccggtcgtgcgtctgaaggctgagacaccaaggtccacatcccacgcaccaatgtggcttctagcttactccgtacttgtggtattgatagggtcagtccccaatttgttgaaccggtagcccggacaatggcttagtccataagtacacatgtacagtacaatcaggccttaattaagatgtgctgtgttcgattacctaagacttggcttcgatttaaaatcttggcacctcgacccatggtttggccgcactaccaagaattgggactcaattcaacccccgccgagcccagttttaggaagtaatcaaccatcacaccagtacctctaacctgtgcaataagcaccagcgatcaaatgcgacgaaatgcagctatatgtcatcaaatacaatcaaatacatttaaatgcgaccagctgcgaccaacggtaacgaaatgcgactaaaatatttgggtatagcagcgggtacggagtacattccactatgtacttacgtcatccaaatgccgcttctctaatttccgccttacatccgctcgcgacacacctcacattgaacggttgctccgatcctgctatgatgctgggggaaaagggcggccatactgcaagctcgcgtaaacgcttggcaaattgtacgcgccccagcacagcaaccaattgtaagcataccctcgtagcatcacaggactatggaacgaagtcgtaatctcatcgttctccttgaaggcgtccacgtcctacggtatgcctgaggaacgtaagagacgaaggatcttccttccgcgccctcctaacccctcaacgcccggttcgctcggcgatctgagcacttctaagcccctattaatgcgccaccatttacgagccaccaccttcgtgaaacgagccacatcggaggagccacaaacttcagttcactctctgtcacactctctgtcgcactctctgtcgtatcctctgtcacactctgtctcactgaacacacactctctctgtctctctctctgtctctctccctctcttttcatttccccgcttttcttcttgacctcgctgaagagttccctacgccttctcgcttcatcatgaaaagaagctagcctcaggacaccggacgcggatccggtcggttagcgtagtgtctgctcctcacccagccttgaataacagaaaggccaccatggttctagggtggctccaggagttgccacgagactgtcgccgcccccgtgacgatgtggtctgaaacagggtggccgagattccgcgtcacccgtgacgtcgccggtatcatgtcaacgtctcatctgggccctcgcccaagttccttttcatgtcgagcatcgccgcgtttgcttggccctctgcttcccgctttctgcgtacatatttacgacgagatcgcttgtacgatgccccgcgaaaagccggtcagggtcccgatcgatgaaatccgccgcacactggaagatcttgacggcaggcgcactggaaacggagctggaggaaggtcgggaccaacctactcgattgtctcaaactcctcggcataccagagcacccatcggctccgtcaagagtcggtcagagttccgcttgacgagatccgaactacgttggaagacctggaccgccgacacgccgaaagatgcactctacgaagacaagagtctcaaaagaccgaggccaagccccggaaggagccggtaagagtcccgcttgatgaaatccgccaaaaattggacgatctggatcgacaacacgccgacacactgacccgtggaagacgagaatcatcccgctccactaccgctgggcaactagcatctcagacacccacccagccccagaaggaggcgataagagttcggcctggcgaggttgctcgtgcatgggatgatattcaacgccagcgcgctgaagaacggggccatcaggcgcaggtagtggcccggcgtgataccgtcatggtgccagatgatgaactcaggcgcacaatggcggctatcacgcagcgacatgcggaagagcgttggcgtgaaagaactgcaagactacgaccacaacatgagactggtcagttcggccgtcgaagagcggaagaggtgcgctgcagacaattaccgacgactccggagcggaccaccagctctccaagaatcccggttccccaagcaatcccacagaccccgcctcccagaaagcgccttcgggaaccacaaccagaaggacttctgaccccgccgcccaccgggccagaccggccccggaaaagaacgaggccgtcgcgagaaaccgccctgctccaacgagagtccctcgacaccattctgcgatatcatgaatctcgtttccgcgacaaagagagggaatcggagacaagatcttggtgcgaagaggttccacttaccctccaggtagagactgcgcagtccttttaccaggcattcacagatgagaggacgctgccgatctcgcactgcaacttttgctacaggaagcagcccccttccgagctcacaaagatccgatggaggaggcacttgacgccctccttgctacaggccactgcagcactccaggagtgcagggactatttctctgccgacgacgacgctgacgccatggtttgctacgaatgctatgcccccttgaagagggggaaactgccgaagacctgtgcggtcaacaatatgtacatcggatgtgagcatcggtatcccgaagagctcgacggcctgtctcccgttgaggagaggctgattgctttgcaggcctccttcggctatatcacaaagttcaccgtcgacaacaagaccccgtcggggctcagctaccggaagcacgtgaagggccatatcgtcgtcttcctaaacaaggtcggcgacctcgttgccacagtcctccctcaccctcttctcgttaccatcgagaacatccacgtctcttggagtggctccagcaagcctggcgctgcagacgttgggaatcttctccgagtgcgtaagtcccacgttcgagctgcgctttcgtggctttcatgttggatggtgtccctgattgaggcgtggtcgccgccccatccgtgaacgtttctccgcgcactggcacaaccgatcgcggtggcgtggtcatcccgcttatagattgtcgtgaatgcgagtctgatgatgcaactgaagataaggacgcgaaccctccctgtgaaggaacatcgaatggcgccgttgatgcttcgacagtatacccctcctggtatgcaggcataaacgatcttggtggtatcctgcctagagaattgtgtggggacaagtccgacgacgaagcagaagaaagagggaaggttgcctctggcagaggtgcatcgtactgttcaatttccgcctcaccactataagtctctctgcgcgtaggcacgaccgaccgtggtggtgtggtcatcccgcctatagagggacattgcgaaggtgtggtcaaatctgcagctgaggaaaatggaaagaccttttcatgtgaagagacctcgaaagatgttgctgctgcttccgaattttccactccacgtgaagccatggtagaccgggttggcagggccatctcacctctggaatttcgtgaaggcaggcctagcgacgcagctaagagtggtgtgggaacctcttctcgcggaatcacgccaagtaacgccacgggtgtctcgctcatataagtctccctacgcgcaggcacaaccgatcgcgggggtgtagccattccaacggagccctcttgttccaaaggctggcccggcgatgcagccggagaaaatggacaggttccctcttgtgggagcacattggaaggcgccgcgcacatgaacgtctccctacctgctggtacgaccgatcgaggcgggggggctatgccgttcacggagctgttccgtttggatggcgggcccgatgacgtaaccgaagaaaagggaaatatcccttcctgcgagagcaagttggagtgctcagttgccgcttcgcccgtaaacgttcctccacgcacaggcgcgactgatcgagacggggtgctcaacccgcttacggagttccccctttctgaaggcagacccgatgacacatctggggagaagggaaagactttatcttgtggaaatccattcgaccagctccttgttgctctgctagatggcatcaccgattgagacggcgctgcctcgcccacgacgctctgtcgtatgcgatctttgacaagtgttgaagcgcaacttcgattgtccggcgtctgttcaggtgccggcgaaccggaataggggctcgagtgagatatacggagccccgaggccatgtgttccaggctggcggccgtttgggggtgggttgtccgcaaggtttcgcgatgggcgtcttgggcagtctctctagtcggtgtattcagagggagggatcttctagatgccttgctattggtcttatccaggccatttgaattgcctcgcctacgtcgagccttcctgcgtcgtcgattaacatgcctacgggatgcccccttccttccttcttgggcggaatcgagacggcggctaagaccaggttcagcctcccctgtttcgtcgatgctctcgccgccgcatgcggggacagcagcgggttgggtttgcacgtcttccattactgtatcactgctggatgcatcgggttcatgttccacttcgatatccatcgcaccgctatcgcctctgggaaatgtgtagggttgatctggcagtgagataatttgcacgttgttgtttgattctatgcgatcatcgatactgaaagcaggagacgcctcgtcaatctcaaagcgacaaggcttgagaagacttcccaccaattcttggaagacagagagggcatctacctcggtggttttgtgattcataatctgaggaagaaaagccgactgctggagacgaaggaacacgctcgtaaacggccgaccccatcgattttccaccgtttgcaagaggttagctatttcctgctcctcgggctctaagccatgatgatacgatgggggcacggagacgtttacaatggggtgctcctctaggcgcacccggaatccaagaagctttgctcttttacgcaccaacgacagatatttccaccggtagagtgatctatgttcttgaaacctctcgtccaacgatttcccgttcgatggaggcgctctttttctaattacttttgttgactcgttgctgatgtatgcaaactctcgcagtatcgatacgagcagcacgttgaatgcgaggctgaacgaaggcgggcctctgacccgttgaaacaccccctcccgaacctcgaccactggttccgtctctgtccaactctccaggagaatggtggagagttctctctccttccctaagaggtcttctggcacgatgtgtttcgtgataatctgcgccgcggtgctcaagaagttcattttggcatgaaacgagcgaaagcctgggaacgtacccggcgcgttacacaccttttgagagatctcagctcgtcgaacaagcttggtgaccctactgaagacccgaccggaacagaagagttccttgatataccggcgatctgaagagctccgcggagagcgtccctcaagttcccggacagtctggagatcaaggtcgccatgatctgcccaggcgtgtttgagggccgccaacgactggatgatcatatcgtcaaggcccaacccaaagtatttcgtgaagcttgccaagtggagaccgtcaagtaatgggctccgcattagagaatcaaggatctgtctgatttccttgcgtttgatgatactctgaaagccctttagcctggaaggtcttaatctcgtttcccattctgcatagtcctttggctggcttctatagtcccgtagcttgcgatatatgtgcgcgtctgtaaatggggtttcgtgttgaaaccactcatgctccttgttaatcgccttgttcgagcgtaggccagacatcttggtcagccagatcttgaccatccagacctgagaggggtcgatggatctggccgccttgacgcgatgacggccgtggatataccagatagttcgcccatcgaggaacgagtgcagccctcgatggtttctggaccgtagctcctgagccgatagatttagctgttgtagaatcgactcggcctcggaatagtccacgtagccattcatccagttccggtcgtcatcgaagttgatgctggacttcctgaacacgctctcaagatgcccagcctggtcctcgtcgtaccaacgttcaccattctcgtgtacgaaacgaaggcaagagacaggtacttcaaactccccaaagaatactttatcctgatgcatttcttcaaacatgtctgcgggttgtgacatagaagatggtgattcaatgcaaaatcgctcatggctattgtgctcattttattctcaatattggtagtctagctgattccgttttctgatctggtcgggttgtaggctgtcggcgactgtctctgtcccgttactctgtccctctgatggcccccggtactgattcctgttccctgtcacctgcttctcagtctcacgactgaaacaggaaaacgaagccagttgcctgcacccatgaccagtgcagaaatcaggagagctaaagttactggcaacctacctgaccaaagcagaaaccagaaaacgacaccgactggaggctggtagaatccatggcaactttggtccacaaaaacataaaacaaaagactgaaaactagacagggaagccaaggtcgccaacagactacaagaatcaggaaaactaagcgtcgccagcgaccctccggagatcaggggtcaggaagactaggggtcgccagcgaccttctagagatcagaattcagggaagctaaaggtcgccagcgaccctctagaaattagagatcagaattcagggaagactaaaaggtcgccagcgaccctctggagatcagggtcatgaaaaccaaaggtcgccagcgaccccccagaaattagagatcaggggtcaggaagactaaaaggtcgctggcgaccttctaaagatcagaattcaggaaacctaaagggtcgccagcgaccctctggagatcagggtcatgaaaactaggggtcgccggcgaccctctagaaattagagatcagaattcagggaagctaaaggtcgccagcgaccctctggatcaagggtcaggaaaactaaaggtcgccagcgaccctctggagatcagggtcaggaaaactaaaggtcgccagcgaccctctagaaattagagatcaggggtcaggaggactaaaaggtcgctggcgaccttctaaagatcagaattcaggaaacctaaaggtcgccagcgaccctctggatcaagggtcaggaaaactaaaggtcgccagcgaccctctggagatcagggtcannnnnnnnnnnnnnnnnnnnnnnnnnnnnnnnnnnnnnnnnnnnnnnnnngaaattagagatcaggggtcaggaggactaaaaggtcgccagcgaccttctaaagatcagaattcaggaaacctaaaggtcgccagcgaccctctggagatcagggtcaggaaacctaaaggtcgccagcgaccctctggagatcagggccatgaaaactaaaggtcgccagcgaccctctggagatcagggtcaggaaaactaaaggtcgccagcgaccctctagaaattagagatcagaattcagggaagctaaaggtcgccagcgaccctctagagatcagaagtcgcgaaaactcaaggtcgccagcgaccctccggaaatcggggatcagagaaggctaaaggtccccagcaacttacttggcccaactacaccaggaaccagaaaacgaaaggattgaggatgaaaggataggagatcgggtaggctcaggctggggtggtctgttgaccctgaaaaaaatcgtctgatgatgcgcgtccgcgaacgatcatgtgagccaacgcaacaggatgtttgtccgtctcatcaagtggtatttctcatcacctccgttacccttccgtcatatccaataaaaattgctccttcgtgttagacgagaaatgccctggctgaagacggcggctaaggagctatagttggagggagtgtttccagaggctagcaaccaacaacaagaagctagcaaccaacagcaccgacgagcaaccgagcggggctgcatgcataaaattttgctcgtcacaaaataaggagttcctttgattgaataaacccctgtcagttgccacactaagtccacgattgcagttatgccattcacgcttgtagccatcggggtccactttctctcctcccggtagggcaagtccccgcagagatatcaaaccccaaacctctctccttatctaggtaggggagtgagatcttgtggactcctaccatgcatgtatgtaattattttagtgcacagtgcggttagcatcctgcggcgcagcaaagtgtaaattcatggccctgcatacgaggcaggggcgatcagatgaagctacgtggaaattgtgtctgctctgcctcctcttgtgcctcttcttgcggctccgacactatgtcagtgaccccactggatttccgttttctctcccttgcatttgcagagattttcagaccggtggtgaagaccacagagcgaatggatttcaaagcctctcgcaaagcgcacatttcctcccgggattgtctagcctccgcttcgagatgttgattctggctgcgcagttcttggttctcccgcttgagctcatggatctctctctcaaggttaatcttctgctggaattcaatatcggttttgaggtcctcgatctgcccaaagagctcctggatcataggttggtgcctaccatcggagcccatggggagagttcgcaactcaatcgcacgctgctctttgccggacggggggggaggcagtggaggcagtggcttgtctggataatacatggctgatacactgatcacttcctcacagttgccaacacaagggagagggggggcatgtttcttatacgagctatcttctcatcaatcactaacgaaaaccgcacaatccctgtgaacctgtaggatactgccgttcaattggccttctgcacaacaaccccccgggggggcgcctactcctcgacactactggtggaagtggcgtcgctggagccgtcggagtcgtcgctggaatcgtcgaagtcgtcggagtcggtaaagcattgactgtctcccgaggactgggagtctgcagatgaactactgcctgaagattcgatgtattctttgagtcggtcttccattgcaagcatgcgttcagcattcctttgctccattccattaagcctttgctccaccctagcatacagctcaatgagtgcggtcaactgtcgttgcagattctgaaggtatccagtccatggctgtgggttatcggagactgtcctccgaagatcctggacgctttcataggtagatcttactagttgttccatcatggccgctctactgtcgacagcgttagtctagattgccgtgggttctgccacccgcaactcacccggcggcgcactcggcagtcagaggggccggctctggggcaacgacctctggagcgacgacctctggagtgacgacctctggagcgaaggactctagagagaagaattcttgaggggcagaatcttgcatcccattgaacatctcttcgttcaccagctcgtcaaatgtgaattcggtgagatgggggtaagtgttgttcatcttgtatcgattgccttgttgcttgtccggtgtggcggctactgtaaggcaggtggctgccttgatttatacctgatcctcgactgtggtttgccgccgccacaaagtgcgatacggaaagctggatcggacatgcgagaaccaggacaccgaaaactgaaaactgagcccacctggtatatattgcacggcaggccgtcttgctcgtaactcttcaccccccgtcttccaacaaactcgcctcgccaacccatcatgcaactccgtcatctcattagcgccgtgttggttgttgctgtgtccggggccctctatcaggagatatgcacggaggaaccgccactcaccttacaggctggtggaatagccacggccacagttcacaacccgcaagctgagcggtgccaagcttatctcgagttcagagacccggatttcctgccaatcacctttctctttgacccaattcattgcgtcggcccccagtgggttcagttcaccctgccagtgggtgtgccgaatggcgatgcttatgtgacatggtgagttctgccctaccccaagcaccaacacactccgctctgcttctgacaggccggccaagggattgcgagggcgattcctcattgagctgctcgcgcatcatcatcagccagggtctaggtaatcttgactctgaggaactcctgcagacgggcatcacagactgtcggccaacatcctcgacttctcgcactgtacatggccagccaacagcgacgccatccagtcctcaaggtcgtcatccaacagaaagctcacctggcttccacatggaaacaccaactgacagtggggctacggcgaccacttccccacaggactccacccctacaacaccgattcccacagggattcagacgacaacggttccctcatcctcacgaagcttctcccccggtataccctttaccccttctggcagcatgccgtcctccgcggtgacgacgggtgtaagcccagatgcctcgacgactcctgccccgttggcctcgacgactcctgccccgttggcctcgacaactcctgctccgtcggtcgtcccgaagaccagccagtcactatccactccggacaccataatcacgagtacgaccgcctccggttcatgctcgcagccaacaatcacaatcacaatcactaagacagcctaacaacaggtcactagctgagtgccttccccttgtccccatccgcgtgttggtctgttggtcgtttggtctgtagctcggccttgtcctcgagtgatccaagcccgctgggcgggcttttactccagctctagtgttagaagaaatatataaagtgctcctatgttgctcccgcatggcctgcacgtcctcaatcgttccttttttgtgacttgcagaatgtcaaatcaaaaccggttgagcgggagggcgcagcatcgcccgttagcccctaggcaacagatgtccatggttccatcccagcctcatcccggccaagcccagactcatctaggtcaagcccagcctcacctaggtcaagcccaacctcatccaggccaagcccagcctcatacaggtcaaacccagcctcatcaagcccagcctcatacaggtcaagcccagcctcatccagctcctgttgctcaaccacagactcatatgtcttacccggaggctcctgtgactcaaccacaggctcagatgacttactcggaggcccctgtggctcagatggcttaccctgaggcttcacagacctcagcacgtcctgccccggccattcacagccaagacttgccaacacaagatattcgtctagtggccgattatagcgacagcctgaatacctcggtccccgctgattatgaaacagcacggcgggaatctataccagcgtcatcaacgacgcagatgacatcgccatctgggcagacaccacgatgctcgactacactaatagagtcacagcctatattgagatcaccgacgataaaccagagccacgtatctaacgctttggaaaatccttccgatggaggccttgatacttcggaggcgaagacaagacggcccagcaacatcgagaacatattagatacgcttgcgactcaatcacgtatcaaccagaacgagatacttatcaaccagaaccagatacgttttatcgataaccgaaccagcaatatggatacccgattgtatgacagagatagagactttgagaaccgaatcaccaggctggagaggcatgttcattacttgaatgaccggaccaggagccccggggaaagggaacgggatcgacgtcgtaggaggaggcgttgagctgtggctatggctgtctggacttcgtctcggtagagcagagtaattcgcaccagtgcttgaccacatactaccaactaatgtaggattcatttctgttaaccgtttgccgtttcctgttaaagtcagccgggattttaacctgtgctggatgcgagtttcctctctcgttctctaccaaattgaaacagctttacttcctagaagacgtcttgccacagtcatggccgttccttggcttcaaatcgaggataataaaatccagcaacactcatctttattcccctatcctgggcgactggtgctgaagattggaccctccctcaacaaggaggcgacgcagaccgtgtgggtagaccgtccaaccaaatctgtttttgtagcagactgccgtgaactcgctgctcagtggaccaggtccgagaacccagtcttgagcgttgcacttcgcctctgcgggcgtgttctagctcccctatgctctgctatcatcatccttgcggacggcccaggtggcccccaatcggccgccaaggcggttgcaggcattttcgcctgcgacccgttcccccaagccccatcaagccctcgtttgctggtcatgtgtcggaaagcagacaagagtctttttcgccgttgtctcatcatcgaggtgcttcacatcctgaggcgactgcacccggaaagcccgcgcagcttctgggacgtccagcactcgctaaaaggcaccctcgattcaatgcaggtcgtatggaatgaacacaccacttctgtcgtacgagaggtagagagggtgtcttggctacagcgaagcacgggcctcggctcctcacacagattgctggggcagctactcatatctggagaagaattgggcctacccagcaacaccattctagacctctatctcgcactagcatcaaacgttgcggaaaactcgagaaacgcccttcagcactttttaacaaagggaatctcttctgggaaggctggatcaaggtcagaaatcgaactcaacacaacggtgtttaggacactcgtcaagagactcgcgcccaatcccaagccagaactcacaagccacaccccacgctgtgacatctgcctgagaggctctcctgtccatcgcctgagctgtagacaccgctgctgtaatgtatgcgctagagagcatgcatcaagggcgctaaatacccgaatcgacctgtgtcctcgctgtggtgcgataaatgaagaggagccatccatcctgccacccacggcgaccttgcgtgctcttgtgctcacggggggcgagactcggatgagacatttcctctacaagttaaggcatctcctctttggccatcttgaagactacttcgacatcgtctcgggctctgggcgttgtgagtattgggccttttttcctccaatgacctcacagctgatttactttctagctgccgaactaattcaagcctactttcatcaccaccttgaactgaaggagtatggacgtctgctaaggtctgtttcaaaattatggcgccataggcagctgccagtgcccgacagtcgaatctgcactctgctccacggttcctgcggcaagaaagaggacggttcctggatttcaaggcgtctctgccaacacgaggacgctgatatcatcagatggaccgaggtcgagtccagcaccatatggggttcgaggcctgggttgctggtccacactcatttaccggtcaaacaggtagcgaatcagctgttcgcgtcgcttttttacgtggccatcatggacagccccgacttctctacaatgcccaagatgtgcgatatcgagatacgatgtcgcctgcgttgcggtgaacatctgtacagggtcatacgtctcatgcgcacggaaaaccttcagctacactgcaattgtaatacggccaagacatctatcgatctcgtgggttcgaactgggatctcatctcctctggcaaattccagggcttcaggaggagacttaatgtaaaagtcaactcgctgttgtcagagattcacgtgtgggttgacagccccattgggcagggtagccgtcaggacatcagcggctctccatatcgcttgatggatcttctggacctgggactctaaggcggcgattatccattggttgctatccgtcccagggtgatttggcgctacatagcatcgctcgggcctgccaccacccccacccccacccccaaacacatctacaccattttttagttcgacagcaccatggaatacaaagacgagaaagccgctcattgcattggacgtgggcatcgaggcgacaacaagggctcagagcagtgaatacagcgtcgttcgttttatcattttactaagtttgtgcagtgaacatagcctctcaccgcatatcactgatggcatcgcagacccgaatgataggcaggagagtagagattaaggctggggcgttgggaccttcggtcagtagcctggaagcaaaggtcgtcagtttggaggccgattcggaccaaacgcacaatcgcttgattgctgctctgggggccacgacatccatgtggcgggaagtagctcatccgtattcgtagtctaatgacgatctctcatggctattgaaaaccgcctcagttcgcgtggattccgatcgcgctcagctgattgaatagcgatttgcgtatcccaccctcccgtcttatccagcaacctcatcctccaacctaactatttccagagaatctggtcctcccttgtcttcctgtagacatggcaagtccccttctttctaggccctctaggccaatcgctttctctgaggacgtggccaatcactttctctgaggacgtggccaatcgctttctctaaagacgtggccaatcacgttctctgaggacgtggccaatcattttctctgaggacgtggccaatcaccatttctgaggacttggccgttggttgagccaaatactagtaataccacctaacagttgagcatccttgccggcagacttggccaatgccctctcttgttcaactcggccaggcaccctcgccttgagcctaatgcctccactaggaaacctgctatcacctggcgaagagaatacttattgccttggaaagactggcgaaatgggtctggctggctggccgttacttacctctcgccgctgacgtggatcctaagtacaacatccagcatgctcacaatatttcagaatgatacgcttaatgcacaagatgcacaagagttgttcgccaatagtattttctgtctatggatacttaacacattattcctattctcttgctggagattttccaacaggtaccgacctcgcggaaacacgcattgacgccttgcacggctaatggcggtgccagtgccatggtggagttactactattgttcccctcgcccatggacatattgtaggcgatggataattctaggccatgtcggttgagctcgcataggatgtgggaagggagggcatcaaggaaccatcggatgagtgagggtatactatcgaactcgttggagaaaaatgtacgggcacagcgctttacatagccttctatcctagcttggtaataaatcatcaaagctggccgcgcaggtctcttgtcttgaatgtcgtgaacggaaatcagtttccggttttcattctcttattatagtgatataaagaaagggtgcgcccgacctataagccgatacgcgtggtcactactagctcctccttgcgaaatggcgaacattttcactctgagtgtcgcagtatggtggtctgtcgtattggcatatgccctatatcgatgctgggtgctcgacttccccaaacaatggaggccttacgtcaagagatgggcacatcaattgatacgtcaatttgaagtatggatagatcattcgacgcatcgatttgtaaaatggatggatcgacggtcgcttggctgggtactcgatttattggaccttcttgggggttgttttgcgagacggacgagctggctctcgagactgatgtatcgatggcttgtgggattgaaatggatcagcttcctaatgagaggtacgggccacatcgtgcgatggacgggccgccaactgcgcataggatggagatggatacaacaggcgccttggcgaaacactttcattctccttctcctctacaccgcagcaaacatcatctttttggtcgcccccgtgcaattgcatatttccactcagaaacgagcaacagttctagcggcgaccaatcttgccccgttgctcctgggcagggacattctcttagtacgcaacttcaccggcttgtcccttcaacagtatcgccttttgtttttcttcctcgtcgggatcgccgcaaccggatcaataattcatgttgcaaaggttgcccaccgcctcgactggacacccaaggctgtgaccggcctcatggtatgtgcccccctagtgtataggtacatactgtacaagtcacgtgaaaccctcactaattatctgtaggccacgatacttctcttccacgtcgccgttctctctctactatcagcaatgctgccccgccgaaggctaagactattttatacctggcccttccgtcttttatttgtggccacgataattttgctgctaacacatgtgtggctccaaccttggctccagtctctggaggcacaacttcccctctccgttgcttgcgggatgtggttggcagccctcgtagcccgaagactttgtcaccagcacagcgaggcggcgtaccgacagtatggaggcaaggcagcccgtcttgaggtcgtactcaaaaggcccattacaatttatccaggggcctatttctacatatactattccccaaccaagatcggcagggcgtctacaatgactacgcaccttggcagcgctagctcttggctaggcagaatgcttgaagcaccaaacaaggtcactcacttgatggagaggctcagtttcatccgccgagaggggccctcgcttattccactcaccgcgattcgctgggaggtgaatgggcacgaggccaatacggtcggcgaggagggagatcctggccttgaaacggccgatcaggatggcaaataccctcgacccgatcgcaacgtgacaaagctgcatttcctgcttaatcaccctctccacatgcaagaaatgctgggatctcccaaaggcagcgttcccgtcaccatcgacggtccgtatgggcgggacttgggtctcgacaagtatcagacggtctgcctcgtggcagactggtcagggattgccggcactctgcccatagcattttctttggccagcaaatggcaatatgacaatcaccagaaaggccaggatcactacagcccaaataatgagttttatcgggccctcacgagacgagtcaatttcttctggatatttaaagagggggccgatgttgattgtgtccgtgacatgctgagcaggttcatgcacatggacccaaagacggttggtacaatgctagccagtttctccaatctattctgaccagcgtagattttcttccaaatcatcctgtatggtccctctgtacagattaaaatccccgagaaattcttgcgatggcatttcaagatacacccttggccatgggaggacttgctagactaccaactcagctggtttctcgaaacctcgcctagctgtgcagtatcaggtatgtacgtcccattctgagtgagcttgtgtaacccggtaaacagtttgcggttcggagaaaacaaggcaaactatacggtcgattgtctataagcagaaaagaatcataccttactatgagaacgactatcagccgcacgaacaagaccaggaccacaagaaactcgaccccgaaatggccatccccgagccatgcactgatggaacagttccttctcttttacctccgctcacggtgccgactgccactgtttcttcgaggagacaggtcttctaccaccactcaagtacagaggacagcatgcgggcgagtatttctgaaacaacgatacattgcgaggcaagagaggcaaggtgtttaacggatagagggcttgctaagagggagtggggcagtcgtcaaacgagctggttaccggaggaaacgagatggtcaggtgaaacggtctataggacttagtggtcgaagagtgtttaagagcatgtttttttcattcaactatttcctctcacgtataaggtactcctcagctcttttcccgacgatcctttatgccagtacgcaaacccttctagaaagggcctagaacctccatgaaaatgcggttacgtcctccctcaaccaaccccttcgtcggtcgcttgagaattgtcttttcgatgcatcttatcgttattaacctgcttttatttacttttgtatctatacttgggtttatcatagaccattttagcctagaaatatctactgaaagctcaaaattgcgtgtggataatggtgtctggaagccatctagagcttggaagtaccttacctcgaggaggcgttatgaccaactacctgttgatgttgtttctggcgcctactaccacattccttgatggatgtatttgtttgatctttgattggtatatatacattgatacatatttttgctaagtcaaagggggggtagaaatcctaccaaaaattatcgcctttgatatttattttcaggagcccgctatcgccagtcttaacctcgcttcaatctagtacaatccataggagcggcaataactatatgtattcatgtaaagcagtctaaaagctcaaagcagcgtatggatggtggtgcctggtggctgtgaaagtatggtacctcgataagttaaccagctaactcataccccgccagtgcctactgtgtatggacagtaccataatcatttcaagcctgtaatcttaaaacccctcttccgtgcctgttggcatatgctataacagccccctcccccagcccaaagtctagccccgagcctgctcgggtcagctttcacatcagcctggctcagaatcgcaggataccatcacatagctcttgaaaaggcattagacttggaaagtaaaacttatagaaaaaaataaagtcaatagcttgctcggaatcatgacactggaattctcttccctgcaattcttgttcgattgcccttccaatggttctcatggtagcagcaagccgttgactagcagctagcatgtcgcaaaaggttataaagctgttctgttctgtgatttgatcatggaccaggctaataaaagccctctcactcatttcagtcgggtaggttaggtattccgtggcctgtgctctctgtgctggcattgccccgctgtgaatggcttgtcttatagactctctaatattttggagatgttcccggcagaggtcactatcggtggcttgaagtacatgctgtatgaccccagccaaattaaacgcggctcccctttcagctgaagagtgaataggatgctcaatactctcgaggccgaataaaatggggggagatgatccttgattggcacttcgatcttcgatgagggtcggagatgtctgagcgtggttgccattgactatagggctatcagcatcgctcctgttgagaagctcaccattgagagcctcacccccattctgaatctcgcctccattgttggaataatattgctctgacatagttactgtctggtgaaaatgaatggtgaagaaataatctctgactccgagtttgtgatttacatttatatgccagacttagaaacgggttcccgatgactgaaatcattttcttggatgtcgtaataggcacctagggcctgatggatacttgttttcaagaaacgtgatgtggtgttcgcgcttactaggcgccaggggcgatactaagtggcggttgattggctggctatgtgtacctaccgcgcttgcctacacacgatgcctcgccgaggtaccctactcctgacccctatgcagcagcttaaacttaactacgcacgcgggtttgagcgttttgcaatacctgtttaggtgatgctcttccccttttggctattcgtttaccatcacgttatccaaaaaaagaatggcagcgaacctctgaagcttcgggccgcgacaatggcttcggcaccctcaaaggcctagtaagcacagaatgccacatattcactacacgtatatatcacatatattctcggagcaagctcaacaattcagactaaatatttctaagccagctcagaaaattccgtacagtaaatctgatccagttctcatcactctgcgggagcataatttcgaggaatctctatatcagattctcctctgccaaaatgcgtatttcgaatcagtgtttcgagcctggggcataccactactaggagatgaatcagggcatctaattgatgtgcagggatagaatctctatcttctcggagagcctgctggtgcttctgaatggtagcggcaatcttgtcaagaaacgtcgccaaatgataaaatggatcgatatctaagttttgaatagcccacgaagcatataggacttttctttcaagggtgcccccaaggatttcgtaattatcctcgattgctgtcgcatatgccatcttcattacatctatgtagaaccggtcgtcaagatattcgcattcgagggaggaactttggggggggttgtctccagaggaggtatcgtgaatcacctccgacctccgagaacttggtgcggtgggcaccatggtggatgtgctgtcgtctgacgagtcactcatagtgcttttgtgaaattgtggatgggtgggggtgggatggggtgggatggggtgagatggaagattaagggagtaaagggagaacaaaagggaatgatataagcgaacaaatgacgccaagacaagagaatctgaagacagactactagattctgtctccaaaatttcgttccctaactcccacttggtagaagctgtttacaggaaacagttttcaagcgtttgtagataatcccctattataaaagaaacccatggtttcaaatccaaatgttgaaaattatcatgaatgttactgccaattatggaggaaatcgaagttcgccgaaaggcccgacagtttcttaggctttcagagaaaaaaccgaaagactttcagtttgcttcaatcacctccagtgacctccagctaatcaaagacttgcgagagccaagtccgaacaatggaaaagaaacggaatatttacaagtttggaaagataaaaataagctcaataaggacttagccgagtggcggctagcggctggagagctagtcgagagacgaacatcaggcactgctagtacacaccgacctcctactgttgaggatgctccggaatatggcgaagagggagagtcaacaacacaagctccaactccaccagcagagcaagctcatcaagtacaaacaacactgcagggacagacgtcagcagcacaaacacctggtccgccgccaacctttagtcaaactgctgttccatacgaatctcctactgttgaggatgctccggaagatagtgaagagggagaatcagccacacaagccccaactccaccagcacgacaagcagatcaagtaacgacgccaccgacagagcaagtacagcaagtacatccaacatcccctacttttgaagatgctccggaacatagcgaagagggagagtcaacaacacaagccctaactccaccggcagagcaagctcatcaagtacaaacaacactgcagggacagacgtcagcagcacaaacacctggtacgccgccaacctttagtcaaactgctgttccatacgaatctcctactgttgaggatgctccggaagatagtgaagagggagaatcagccacacaagccccaactccaccagcacaacaagcagagcaagcacagcaagcatcaacagggagtagatttctaagaagtagtagcgccaccgttccaatcgagccccttcctcctcgccttacttccagacttcctcctcgatctacttccgggcctcctcctcgccttacttccagacttcctcctcgatctacttccgggcctcctcctcgctctacttccgggcctcctcctcgctctacttccgggcctccctcctctgctactaggccgtcctcctctgcttccaggccatcctcctctgcttctaggcctcctgtcgagggaccattcactccttctcctctttcgaatcgcttgatctctcctctcactgggaatccttccgagagggattccgaagagccccttccgccctatcctgggcccccgcctgcctcccctcgcccctcagcacctgcctcccctcgcccctcatcacctgcctcccctcgcacctcagcatctgcctcccctcgtacctcagcatctgcctcccctcgcacctcagcacctaccgggcaatactcgtttgacggttgggagaattttgaacctcaaatatgggagcagacgcatccggccaacgatgatgggctaatggaacgacctcatttcctatatcgagagggttatatattaaacaaccgttcggacgagcttattcgtgcaccatctaagtttggggactactgggaagaggttccgaacccatggtatagagatgaccccagcggctcggagaagcccctcatatggggcctctgcgaaggactaacaaagggaaggtcaccgttatttctccttccagggccaagcggagcaagacttattattttgtcgactcagttgagtacgacaaagatacagtttgataagaaaaaaaaaccacttgaacagataccatatgtccctaagacagatttgttgactgtcaggaagcctctgatcgttgcaagatgctatgcaatttcgaagggcccacgtaacgcaaatacattattggtgtatgttggtttagatagaagcggtcgctggaggaagccacaatatctcggcctgtcggagttcaaccactgctgcgggtcatcacgagttaaggaggccacaaagcgcctgtctcccccacctgaatggagtgttggcgacaagaaggaggaggaggaagaggaacctgtccaaagcccggtttctggaactggcttctctccctctgtccagccacagcttcaacaacagcaacggactcaccacttctcctccgccactcaattacaatccccaccaactgactactctactccgacctacccctcaaggcctcaacaacagcaacagcaacagcaacagcaacaacaacaggctcaccactctgctcgcacggttcacttctcctccgcttctcagttacagtccccaccaactgactactccggtcctgcctaccctccaaggaccccaccacaagcccaggttaatcatccagctcagccacagcctcagcaacagcaacgggctcaccactttgctcgcacggttcacttctctccctctgttcagccacagcctcaagcaggccagcgtatccagcctggagcccacctcccttcttctgtccagccacagcctcagcaacagcaacaggctcaccactctactcgcacggttcacttctcccccgcttctcagttacaacccccaccagctgactactccggtcctgcctaccctccagggcccccaccagaagcccagggtaattattcagctcctgctcaccctcctcctcacgcccatgaaactccagttccttactccgctcccactcgcactcgcggcggacactactttgacagccgagagacatcaattgaatccgaggaaaataacaattggtacggatcgccggccagtagtagctatacttccgcatcactccacagggctggtgccacaaaccggatgaagcccccggagttcacagctgaacagttgtattacctgaggagtcagggaatcaatttgagatagctaaacagacaatggtcttaggagctggactcctagtagcctatttttccttactataactagcaacccagtactaagttagattgatcaaatttactctctttgctcgagctcgactagctagtagacataaacctttcctagcctatgcgtagtataaaaaagtgtaagccaagcacacgactaagaaatgatcactcagcccaaactacaaccacacgatccgaatgtgccctccagactcgtgtaatcccccaagggaggtccacgagctgatcgtccgaagcacaagcgcctggctaattcgtgtcgaataccaacccctggcttgtctccacgcccgacaccttcgatctcgaaccagcaggttcatgcttagggtcagtaatagaaggctccccgagaaagtagaacccggaagaaaaagggatcatatttcctgggacaacctcaagatgagcagtttcgcattctactagaggttcactgttgcgtagcatcgaagcctgacgcatcaatacaatgaattggtctccaagcgataacctccttttacgccctaaacttacaccttcctagcatatgacccaccgatcaagtgattagttattgggtggtcgcatgggctggaatttctattcatgttgtcagattacagcgtagcgcttggccgcgggcccatagactccctagaccaggggagggcaggtccgcgtgtacgtatgcgtggcggctagctcttgttgcttgccgcggacgtgagcacacgtacgcagttcaagctgttgagatgatgaacaatcctactgaagcaaggcaagacttacggcagtacggtctttgccgcttgccattctaaataggcgcctcaactcctgttcttggaagacagcttcctggaccctgctcggcgcaaacgctcgtggcgcgcgcgtaggagggagccaataaagtagataatatctttttttagtattacactttccctttgatgaggctcgaagcaagtatataagaccttcatgtatccgtctagaagactgaaaacacaaacactccaacacgcagatactccaaaacgcagtcactccaacacgcaaccactccatcacgcaagcatgtcagcccggaacacaaaagtcaagcgaagcttcgacactcgaacatttggcctccacaaaaaagcaaccgaacttcacaagttatctggggccaacgcattagtgctaactctgtacgagggcaaactacgttgcttcagctcacactctgccaaagagtggcccattatacgccctataatcgagcaactccgcatcggcgacacattactaggaccagcccacttcacctcggtgagcgagcacatgtccctctctcgaggttcttccactgcctcggattcggatgttgcctccgtcggcaccgccctaccagaaccccccatcccacatcttgatatgccaagcagtcttagcaatcctggagatttaacgctcctggatgatgatgctgtgagacagtcctatctagtggatctagaaaatttgcggttactacagtctggccagagtccagtcggccagagtgtcatcaccaggcccggtctctccagacctccgacccctccgttgacgccgagccctcccactaccccaagcctccccgccattcaagacccttcggatgaagactgggcgtggtgtaactctaaggttttacaagacgttaacgactcattctccttgggatctcccttgctgtttcaatctctggaggcagatgcaatcgcagaaccaatagatccagccagatccgctccgctccaaagacctagcaagaaggagcacagaaagagaaaacgaggcatagatgatggccctggtaaaaagaggaggggaaatcctgcactaacacgcacacgacgaaatgcaccaactttctcttagatggtctttccttccgtctcttcagcattgaattctctagagcaggctttggagctcggtgcacagaatatgtagatttgatggtagatatagagactaattgaaaaatgtttacccccctattcctccgtggttggaaatggtgtctcaggaccatctggccttcgctgcaaaacccatcagtctctgccgaagcggcaatcgcattacaaggagggtatttacttctctagataatgctgtcagcaaatcggtgaggggagtcttggtcttgatgcgcggcaaaggggcggcgacatcgtggctatctactctcttctcaggcggcggggtcacctgaatggatggtaaggaggtgctagcaccccggccggcattgtccttgccaggcgccgaggaggccttgacaacagaagaggctttggccttgtcagacatgttagtcgcagagcgatgagtagcagcagcttgcccagggtcggcccagggtcggccttggattctttatatagccggtcaggctggtggcccattaggaggaacacacaggccaataggggccagccagtcccctaggccatgagaacataactacccacacgtctagccaatggaagtcagattcgccctacatataaagccccttccaggaccaagcttcttgattgtcgatcctgcctgtaccgcaaggcgaaaatggagaacaacggtcagcttcggcggaaactagagattatggccctcaagatatttccattggtccaggtgacatctggaaccgcccacccttatttcccacagactattctccatttctggctcctgacagatgctgagcttgaagagctcgcgaggttctatcaccagcacagagcctgtcccgagtcagccctatatccatgccctattgcttgggagacgggcttcacaacgtcaaagaagcgacaagagtttggccgattcattggcctctcaatggcatatgtcacctcatgtggaccagacgatgggagcaaggccgagtcgacacttcgatgtcttgattggctgcgataatgtaactacttgaacctcttattggctgcaatgacccttccaatcatataacaccctgttccggagtggctctataacaagtggtccgttggctgtcgtccttgcaaattaatctcccttacgaaacaaaatggccagccgtcggtcgaatcctcagccaaacgacatgtttgacccccggtggaaaccagaacaccggcttgtcttgaaggaaaactgtcagtgtggcaagcgcattgaagaaatcgggattttggtagaaggcttgaaagaaaggctacaggctcttgagagccgtttgagcgaggaagattatgacatgtgcgatgtgacacccggaaatagtggcctgcctcacctcgtcgctggcagagccagccgagcgcttgactgagccaagtcttctccttgaacacgctgacgacatcgcgagaccctgttttatcagaggtctttcgttcgcagagaagtttggccaccatcacaacttgatctggtaaatcgcgaatagagagctcgttttgtggctcgaaggtgtgcccacagactcgagagacggataatatgctcacttcacaaggcgtcctgttgagaatagcgtcaatacaagccgggatctcgtatgttattttccaatcttcatactccatgatgaatgtagtctacgagagaaaaatattcgaagagttgattgagaatcagtggtatatatctggtcgatcccgtacctcagcttaccgaaaacacaaaacgacttaacagtataccaattcctgcttccgggaagttgatgatcctctcgtctatttaaactaaacaggatatctgtctctcccatcccaacctccaagacgcagtaagaatgaccaaatcaagtaacctggcacgaacacaatggagggagaagtgtaggcaaaagctggcgcaacacatatgtaatgcttatccgccccgggttgttgatgaggaatgactgaacagcctttagacgaaactttgcacataaagatcaacccagcagatgtccggctaaaaccaggggccgaggaccgttaccaatgggcaccgaatgtcgagaagcctcatctctttgatcccaaactctttcaaaagcatcttagcaaactctccatagggccgctgatggagttatatcgcggggcaggggtttctttctgtgctatgaagccagaggcagagaagcaagcacagccagaacacgagctacaagatagcataaagagagtacaagaagaaatgcgaagaaatatgctgcaagcagaggaaggtttgaagaatgagagacgtgaaaggaagagattactacgagagaataagaggcaaaggaagacaatctcgaggtttaggagcatgatgactatgttcttacaggaatgtgcagatcttgagtcaaatcaatatgcatgagcaagagtcaagagtccaatcattaatctaccaactggctccgaacttgagagaaattaattgaccgttgcccttgccacgatttggttcattgctatcatcttgaagcagcgcgagcagcacttaggtattttccctattttttagaggccgctctattgtactgagggttgcttaggatctccataaccatctattgagtggcaaagtatcttggacttagcgagatacttatctgccactgacatatgatagtagatgaggtatctcacatcagaggaacttctagtcggatacctctccaagataccgactgctgctcgcgctgcgccagggcacaaaacaaacatcccctgtactttcgaccatttacatacagccagcaaccgagaaagcatcgcaaagagccattgcaacaagtggtgcaacctttgccgaacagatgtccgcgtacattcccgtctcttacaacagacaatttccacatctttctatacacaggtgcggtaagaataatgttctgaatgaagtaatctccagtaaatactagtagagccctctagcaccagcatgatagcaaattggctagcctgttagctgatcatgagattagttagtcagcttgtacagtccagtaccataaacacaaaacgcgcgcgcataaaaaatgaactccaatgcgagaagtcttacacaagagcaaggaagtcactccttactgaatttggcagaggaatacctagacactctactgattaacatttggtcggggtccgtcgagcaccctcagggatcttacagggaatcaagtattataattggtcaactcaccatccaagccaattacagcacttgatcctttggaggagccatgtaagatccctgcggcgtctgctgaccggggttaatcaagccctcaggggtcttgtaggggaataagtgctgtaattggccgggaaagtgagtcgaccaattacagcatttgactctctgtaagagccttgtgagatccctgcggcgccactggtccgttgaccggggtgttccctttgactaagaggcaagaagcccatcgactgacgagaccgattggctcctcgtccatcgagagaagacgggagatgagcggacacgttcaagatcccattatatcaggcatgcacctcattcataggtattgtagatgtgtcctcatgttcaagactctacatcatgtctattacgtgcaagattcgcgatcaccacacttcacctatatccggccgctttgttcgattggaagatgaacatcacctctacgacctttgggcaaagacagacgaaacaggtcaggtgcttcgttggaaccaagatgtgccacgaaacaatgcacgagggtattggtgtttgacattctaccctgaccgagcagctcccaacgggatatttcaagaacccatgatacatttttatcatgacgagtctaaggatctccacatcactctcaccctcagcgagcacggatatctcgtcgggatatctgacaaggccgaagccgacaacacgcacgtacaagcgaaggatactcaaatggagccaagacgctccaagcgtcgaaagcagcgttccacgtagcaaactcaatcctccagggttatgaaaaaagaatttagatgaaactaaaaacttcagtctgaataacacgaaaaataagaaagaccagctttcatccaagtgagcgaattgatagtgtctaatccagggattcgagtgtgcccagttgctcggggatcccggcaaagttgaggtcttgacccctttcgtagtccacatcccccgtctcgagctcgccatcgcggatcaagatgtccatacagctcgtgtagatctccggctgcccggtagggtactctcttgtcggctccgaaggccaatcccaaacccagtacaatgtatactgtccattcagaccagctggaagccgaatatcgacctgacaccacaagtctccatcctgagggggtgttggtgccttgtcatacgtcttctgtcgaaaacgggattctgtcccgtcgtttctttgatagcaccgaccatcatcaaaggcccactgtgcaaggagtttcccccgcctatcaccacctcgaccttctcgatcccatactccgtgaatcgacccaaacaggtcgcccatcgaaggtgaagaggtgccatagacaaagacttgaccgggggtggatttgtggggattaagccacggcaaagtcacatggccattttcttgatactgcaacgcaacaaagctacccggcgccgcaatgagccgtggaaagtttgcgctgtagttgctcgtcctctgtgtttccttgcacatgaatgttgaatccagaagatggagcatctgactatcctcaaaagatggaccatagcgagagacagcccccctgataaagccagggtctccaacgaacgttccctcaagactgatccgcatcagtctctcgacccaagagtgagccaaggcaagtgaggcaatacacaagagcccatggattgcgtggctatgcatgattcctaatggtcttagacttcattcatcacaatcatctacagcaatattatatagcaagagttttgtcctaaaccagtttactgaaaccaggccttaggcagaattcccgttttctgtaagtatcttggtgaatatggggaggttacccaagattggagctacacgccgttctggttgatcaattctctcaaaacatcttgcaaaacgcaccgcgaaagagcatccgcttcctctgccgtgcacgcgacgcccgcattctctaaatattctccaatcactatgtgccccttttcatcccaaaagtcgcgagtaatcgataccgccagcccaacaccagaggagaggtagggatccaagttaggtagggaaccagaggcttcaaatactgttcccagaatacgccgccaacggcccttgaaactattctccccactgtccttctccaccagttctcctttctgttcaatgctgatgccgtcgactgggctctcccttcgcggacatgttcgtgcacggagatgatcgtcacgttctgtagctgtgacgaatgtctgagagcagatagggcagtacgggggctgtacatgatgctcttgaagatgcttgatgacagcttcgatcgattgaagactgcattccaggagacaagtctgatacttgtctggacggaggagatagtaagggcatgccaagtggaagtggccgtttgaacgattctgagacaccggctgatcgtttgatgatctttcgtaccccgcaacgcccacattgttctttacgcgttgaaagacgaagccgaagacggccgaacgatgcgaagtgagctggtggctcagtgcaaattcttcagcggattccggttccatcggtctaggtgctcttaatggctgagcagtcagacaaaaaagttttgcctgcgcgggatattaagtcacggcgtggtagatgcgacgtcggtatgctcaatatcaccccaagcaaaaaattagattattatccctataagaaagagggatagatgccagccacctagtcgtgtttacatatatagggtaggggaagcctcggacgaagggcacctcgatgattacgcgagcagctattgctctctagatacttgcacccccctcccatcccctcctgttccggggttaggcacaaaaagatggcgaatacgccttgagtctttggcaagcaggtgggagggcaatggccaatagcgtaagccagtgagctgggccaacaatctggctggttggactccacgatgagccgctggcaaatccgacccccaaatgcacgccccatgcactctatctcaacggatacaaaaagaaccaatggaaattcacatattattttgaccaaggaggaggggtgctctcactgcatcttaccacaaatgacacccctcccagtactacaagtcaacctgtaagaaagcgatactaacgagtcctcattctttgcttttgcacacatcctttccataggtacagcgaagctgaaactgaggatcatgtggccggacctcggtctgaccagcctacgtgcataccatcagtacataatagacgagcgccacttcgcgtgccagaatacgacagctattcatgaagtcctgtctcaactcaactgatttaccatcagcgcgtgaaaccattctttccaaggcgcgctagatatatgaagcttccctcctcagtgtcatcgagaagaacgtttgcaagtattcggaataacgctcttgctcttcattttcaacaagatgctagcctcagacactcaggccagtcaagaccttctcttaactcttcctctaggcaagtaccttttagatgccccttctacaattccctcttattcatgtcttactagatatcaagcgtgtaattcttgagctacttataggactagggcctgtcaacttttatcaaccagggaaataccaagattgctgcaccaagggacaccaaatcccgcttcatacgccttggtctccgtggtgcctaacgcagctatcaaaggctcatcgtgaccattggtattcgctatgctacgatttgacaatacatcggatctgtttgccccagctgggtgattatatcaacacctattgcaaaggacgatatcaactattcccggcccacgatatagtagttgtcatatgcgctaacgccttatttgacactccaataaatgtgctgctcagagccgaggagcttttcccgggatttgggctaaccctagagccttaccaatggggcagggactcatgggctgatgaaaacttcgagagagagagaagcctctggtatcgtgtctttgagcagctcgtgaatcttttctctcaaggcttgatgcaagaactacttcctgatgcaaggaagatagaaagcctttttcttcatagagatgcaacgcttcgacttcacccaacgccagactatctacaccaatccccagctctcgacccagagatccgcaactcgctctatgggctatggaaccgtgttgatgttaacaccatagaactgctggttctgccccctgtctacaaagactacaaacaagaagctcgttcgatacgggagggctctaaagtagatcacccgttttggcgaaatgcccaaggcgaaagcttcatcacggacgttcagtgcatgcgaaacgcccaaggcgaaagctttatcgtggacgttcagtgcatgcctgggtttgagtttgttgttaaaccttctccacacatcctcccttgcggtcatagcctgatgggtattgggatcaatgagcaggagatacgactagtgaccggtgtagccgtatacgtgtccctattaacaccccgggacgaggagttcgacatcctggtcggaagcaaagagggagacgagagctatattattcatggaactactaatgacgacaatgaaaccggcgaggaagaggaagaggaggaggcaatgcttgaatctctaagcgaagatatggaggtgccgctctcagaagtgttggagaacgtatatggccaatctgggtattctgacgtacaagatgttgtggggactcagaggataagacaccaagttgaatatcccagcagagaatatgcgcagtagtcgttggcgagtgtataacacggccatcctatcccgatagttgttttctgacacaagtcaaattctataaatatcagcatccctaactcctaaaagcaccttgctgccagaatctttaatagtgctacctaggttggaagatcgctgcttatccggtggttagaggctctccaaagggtagtaactcaagaggccgagcaggtaatatttgagtaagcatagtcaaaggcttccagataccctaccatctggataacagcggcgcagaccactaagatatgcataaatgagtgggagctacacatatcgaattttccaggccagcaaatttcaggaaacctcatcttcaaagcatatgtattaggattaatttttctcctcatctcaaaacagctgttgtttaaagttgaataaaaagacgagagggcaattcgttcactgatccggacgacgtgcaattgttccaccacaggcccacgtgcaatcggacttccatgccctccgtagccccatacccatccaattggctcgcctcatctgtgtgtgtcaagagggggtcatctatctccataaccgaccaataggacggggaacagcagctgcctagctgcatgagacccccttacgtcatgtccacacccaacccaacgctgattggcgggccatttggcaggctcgttattggccagtcttctaacggaaatgactggctagtccctaactcctcggcgattggccagcttcatagctcatatgaagagggctgaggacggaaatgaacaccaagactagccagttcatcccaatcctcgcctcacggcaccgacccgtgtaagagaatagcaagcaacatgcccaagtaccaagcgtcagcctttcctcatgacgaccacgagttcttagaaatatgtgccaccaagagaaccaaaaataacaagactcaataccagatcaagtgggcaaacacttgggtaggactccataggcttgatgaggaaaccttgaaagtggcaaaagacctggcgatgcaggaattcggcgacgacgacccttcgctttgggtatacagaccgtttcctgccggtcacgaactatttgaggtcgatatccctacaaagatccggaagggtaggaatggcatcgaggtggaggtcagatggaagaagcaatgggttccaggctcctacctaggcgacccagagttcaagccaggtaagaagacgctcgggatcttctgcattgtgttatagatttaacaagaacttacttcaaaggtcgtgattaattccaccagaagatatccaagtcaggcgtgctgatttagctagtcattgatgtaaatctcactcgcaacagatattcatatacattaagctcgaagttaggcttccccatcaagctcccgccagttgttaccaataatcagtttctcaattcctcctttagtattaaccgatgtaacatgtatgattcctgagggctgtacccgggtccagtaggtatctcgggctagatagcctccctggctggcccttcctattaattctgacaagtagtagactccaaccttgacagttttgcccagagatattgtacttacaggagtgtgcggggtcggaccaatgcccgtaggcatcgcagtacaagctgcttaacaattgtgtgtggctagctggccaatactacagtctcgatcgaaacctgagccgaaacaccgagtctggtatctgtttcaaacaccacccgaagaggggttgccgagctgtcctaggtctatcgtggagacacatcgaacagatccaagacaaataaaagcctaggtacaagagatttatgtgcataaaaaaaagtccgctggcagatcccacctcagcagggataggggaagctcaaccttttcgtgttggttcggcttctatccagctggatgtggcgacgaacagtttgctgaggtcgggatagggcctaggccatgaagtccttgcgaatcttggcagcacaggcgggctgtatggtaaagccgactctaacccaacgatgaacgaggtccgactgcccagtagcctgctgtggctaaacccagcatgctagacgagaacagctccggtgcaactgtcgcgcggagagaattaaggacattgtgtacaacttgaaaggctcgccacgacaactgtgttgtgtctgccgatactccatcgccattgccgtatctgagaaacatatggagtagccgcgcctcggaggacaacaaccaaggagagaatgaaggcaatctcttgtatctagaattcgagtgcgcatttgtcgatagagtgagttgggcaggtttcaggaaactcgagacagacattgatggatggtatgatctggaaatggcagaattgtgcgaaaggcgcatgtggccagaagaaagcctactccagcttcctggttggctattttggcccctcgtcaataatcggtcctcgccctcgtctgaccaacagacagcagagagccaaaaagtcaatcaaacgggagaaggctttgcgttctcgtggacacgtactctgatgtacttctcgttgcgttagtaaccgtctctactgccgttacgaaagcacagcctctggccggctcaggttcctattttgagttaatttagctgtagagccggcaaaatgaccgtccagcctttgccgcagcctaggcaggtctattgacacgccaaatgcgagacaacaaacaatagagaagagggaacacgcccggacataggtttaccgtcagcatccagaaaccacccacgcccccctggcaccaagtcatcacaccccagccaccatcaaatatctcgggcctcccggtgtaatccactggatacgtgcaagtacaggaataccagaaagtcatcacaccccaccgaaagtgttggcccaccaggcaggatgtaaaagggtgtggacggtagagaaaagccctgtagagctgtaaaaactattccctttcgagggtaccaccaagtcggagctgatgctaagtacttatgagctgtatgcgcagagggcgtggctctagagcgacccacatactactggcttggatgccgtcgtccaagccagagagagcacttcgcccgacgtcacctcaacagtcacgggcaaattttcgctgagcggcacacaaatgtgaagttatctcgcggagtgagtacagaacgttgtaggggcagtgtatcgttgtgcggaatttcaactataaaacgatgcagactcctaccacattctctccatcaaaaagtttccctatctctctttgcccgatctgacccgccttaaacaaaatcaccttgaagcacatggccacaggcaagcactggtcatcgaaacccatacaaagacaacccagagggaggccatgcaaatcaggatcccacccggctccgtcggccaacaccttcctcaggatgagattatcagtagcaacgacccggcatggcagctcgacgcgtctcaccaagagaccacgatggagcagcacagcgaatttaaagaaagcatatcggataatgaagaaagcatatcggataatgaagaaagcatagcggattctgaagaaagcacgttggatggcaacttggacgacaatatcgactttgaagacgcagacagcgaccccctcaatctggatctcgaacctctagccgagctattgagtgatgatttgtttgcccaaggaatgtgcgaatggcttacaactaccaagtacatcgtgccagagcaagacagactagccttacccgaccccagaccggttgaccctgatgttgacaagccgaaagactatcgcctcgtgtgcccgttctacctacacgatccgaaaggttatcagtcttgccttgaaaatccgctccatacgatcaatgagttgaaactacatattggtgaaatacatcctacaccgccgtactgcgcgatctgtcgcaagtcgttcgacactgctttttcgagggatacccacacgaacgcacgggtttgtaaacctggcaaatgcgatgtaccccagggttacaaccaaaaccaaatgatacgactatggaaatgcgaaaataattccatgcctgatgcagaacggtggatgaacatttattggataggatttgaccgtctaaaggggaaatacccttctagtgtggcatacctcactgacggcctgggcctgattataaccaaaatttacgactacatcaacgtcttcttgggaggtcaggcgggggctcggtatcttcgcttcacatggcgcgagctgaaagcaactggttggctcaacgcattcatccggcaatatctagaccatgtccagtcccacggtgaagcaatctcactgactgaggaagaagcaatgagaatctctcactggctaaacaagtggttaagacacatctttcctagaaatgagcataccgccgactcgagtttcccaacctgtatcctcaaagggaggcttcgggagagggattcctgagagattaatacaagggtgcaatagatgagcacaaatatggtcaagtgctgcctagaataccaaagggcccttgactcctatcgctatacttcttcaacagcagtataaggcccgaatactatctcaacaatagtacaaccggaaacagatcacacgtatagatggtttcgtcatattcttcttgttgttctaatttagtttgctactgatttactacctactacataaatccacacatcttcaatgtgcaatacggatttccacataaatgccagaagaatcatacacccgagcccagaatgtgctacacacctaagtcgctaaacttcttgagccgctagatcacaggcagtagattggtgggcgtgtgggtgatttggtcacatcgtctcacccgcagcctgactcaacgcagcaatgaggaattagccaccagaagcaacggcttcctgatatccaggctcgttcgtctcggaatccatacttcatcaattttccatggtccctaagtgtcactgatcaccacacttaagtgtgctctagaaagtagaagttgctggccagctaggagggttaccttagccacacacccgcctcgcacgcagctatgaaactggcacacctggcgcccttgaaacccgatcaaagcttctgtaacctgatcgcaaacagacacgcaaacagaacaaagccattcaatagtttattgctcagaaggggatagagatacgggttcagccacgatatcatcagctcacagtcgagagcaaaatgattcagctcaagactagagacaggacaaatgtgagtcagcgtaactaaacaccctccaacagcctgaataccgttagccaagccgcccaaatgagtaagactacgatttggcgtcgagccaacctatgtaggtgaggcagtagctaccaggtaggtagtcaagacaagatcggaacaggattatctaatttccggctagtcggttaaggcggattttgaacgaaaatccgccctgttgccccatcaacaagcatggcgcacatcgatcaatcggatcttaggatcattattgcaaagcttgagggtgtggagtctgcacttgctgagattagatctctaagtgttcgacggagccatcgcaatctacgaaatcatgtcgcgtccgacacctccaccaaaggcagcccgtcagcccgcgatgcaaactcgtcacccccggattacggctcatcgaccgacaatgaaaagagactagcaaccattgaagaagcaattcgagagataagggaagcaatcaagccaattgtagcccgcacgcttgcatcctcgttgcccaccaacaaccgagcagccaccactcacgttccgaccgagagtgttctaagttcaaatctacccagcgatgcgaacgccaatggcttacaaatcagtgagaccgatatcccgagcatcgatcatgacaatggcgagacaagcataggcaggaacagccagactatagcagtcggaatcaacgagctcgtggaggtatctaccgcacaagtgggagacaccagggagaccattatagcacagacaggagacaccgtgcgggcggaacacattacgcaggttggagacactgcaataacgggagatccgacaaaggcaggcgcaacacagccggaagacgcctcacaagcgggaaacacgacacaggcgagagacacggcacaagtgggagacgaaacaggggcggccaccatacggataggagacccccagcagccggaagacacctcacaagtgggagatgcggcagaagcaggagacgcgacaaaggcagactccctgcaggcaggagacatcgcacaagcggcagccacgtgggcgggagacacagcaactctttctgcggaggcgggtccagtacccttaatagaagcgggagtcatctcggaggcgggggacacaacagaggcagacatggacacagacgcaatggaaacagaaagcacgggggcaacagagactaccgagactaaattctccctatcacccgtcgactttggcttacgcctagtcccaactctggtcaactttctgtcagatcctgatttctctggtagagtgtcttgcactccaactttggacattgacaacattaaaccgaaggatgtctcactctttgctgatctggattacacaacaaactactacagccatttatatgaccagcggggatgctcaacccttaccatctcaaaagagaaggcgaattttaaatggcctgatttaacagaggttatacagccgaccgaagaggaggccagacagtttcttgagaggattattatacagccaagcgagactcctatctcttatggtggaggagtgccgtcctggcgatccagccatccgctggatcccggggactctctgcgagatcatcctgatttcaaggttctcaaccaggagtactggcatgttggggagcagttctctggtactgcttttcaccatgaggatggtgggttgagatcatgcaacattattgaatctggtataaaaatctgtcttttagtcccacctgaggcgaagaaagagttagaggctcttggcaaccggattgcaccaagtgctgtacccagttgctctcaggatttacgacataagaacctcttggtcgcaccatcacggctagcagcagaacaaatcccgttcaggatattatgcctaggaccaggtgatatgatggtcacacaaccatatgaatatcatttttgtgttaactttacagcctgcctatctagatcgattaacttttcggttcctggggaatccctcttcccagataagatggctgtctgcgaaagttgtggcctttatccgcttcacaagaaatatgggttttctgttattgttactaagaagagaaaatctgctttggcctgctccccccgagcacagaaaatatctcgttcctgctcaaaggtagtttctgatatacaaaacaagtcccccggctacctccttttatctctccatacgcagcagttttctacgcttgtacctgatcaccagacaaaggtgatccagatggctgctatactttgcagtaaagatgctatcattcagtttacacaacttgtttatgcatggaaaaattattcgaaacaaacaaaagaactcttagcaggagaggatgagttaaagtacaccctccgagctcttaaacaaagctcgtcagataagcttatatgcaagtttcgacatcgagcacattttcttcaattaggaatgatcctagagcagcacagacatggagaacgcttagcnggtggacattatggccatgctcttcacgctgcttcagcaggagggcatctaaagatcgctgagatgctaattcagaagggcgctgatgtcaatgcccaaggtaaagggtatgacaatgctcttcaggcagcttcagcaagagggcatctagagatcgcatcgtcccccaggctgggaagcagaggggcttgttcctaacaaaggcagatgcggtgggcctcctcattcatcgctctctcaaatattgaacgttctgatgtgaaacatggggttgtagagtatggctgattggtcccacgaatgtctctcaggatggcgctacttgaaacaagttttttttttttaaccatacataagtatcgaatttggcgactgtgctcagagacgataaaagaaacgaaaaatggccatagccagcttcgttcctcaaggctcctttgcgcaaaccacgactggtttgcctctcctgtaagatggtacttatgcaattgtctcattatgttgaggtatctcattggacggcggatgcatgtagagaagacggtctattggccagccaggccctttatataattggccaaaacatccatcagcatgacctagcccaatggcggatcttgtatcatttctagttgaatctttcatcagctgaattcacgtccattggttggacgttcagcgaccccattggttagatcatgcttaccgattttcgcgagaggacaagctattaatagtatcatctatgattgataccataatgaaggacatgctgtcctagaagaggctccaggatatggaggacagctattcaaatagcaggaggacacttatgtccatacccggaactagataaatggggaaggacaattcacatcatgagagaggacaacctcaagtgttcctatacgatggacaggctatttgttggctatttaaagtctagacgacgccggcaaaggcatacggtattatgctttccaccaacaactattcttaaacagtccgtaattctttgctgtgcctttacacccacctgttatcccgggcagtctttcgaatctgcttaatcattacaatgccgtaagcctagtcttttctgtcataacatgtacctattgagggggataaattaattgaagaaacaagcgaggagaagagccagcccgacaagcaatcgcacagcttggaagaatacacctccagcttgacgacttcaactgtctccgaaagaatagggaatcaaaagaagccataccatggtagtgagaatcttgccagggaacaaatggcctcccacttgcacgaatggcaaaaggcttgagagaaagaacagagcactaatgtgattagaagtggccagaactgagatcgtccgtatgaatttcaaggagatcagaaataagagtttagcccaagattgtagccgatagttatagtggtcgactctaggcccgaggtctagcgattggttctgttctcacagattttatctgtcaaggttattccatcactgcgtgacatagtaaacgaagttgttgtgggtcaatacaatcaagtcttattcccaacaaagactacctagctactagattatcaatggatgtgacgaggcacacaatataactaactaagatgttaaccataagcgaaattgttggcagacaagatataaccagtaatgaaggtctcccacatgccattgttttaggaaaagccagagccagccacccagctaacatcgtcgttgaacagagtagcagactcaaattccttgggtccaccgttgctcgcagcgtagcccaaagcattgaaatgacggatgtaatgggcgggatagttccatgaccgaattgagctgccctgaccattcaaaccagcctgtgtgcagtacgtagcgtcttcaccgaatagctttgagccatcgttgctgttaacataaagttggaagttggaatggcgaataaaactgccgggtgtatctacagattcaaacgaataacaggcgctgttcccaagacctgtgcgcaccacccaactggcctgctgttgaagcgcggtgctgctggatgatgaaatctcttgggtgttgaccgcatcgccagtgtgtgcaaggtaacgtgtcgtgcaacaggatgtagtagctcgaagggtaatggtagatccaacagtcagttcaggaccgctgttcatggctgtaactgcatatttggcagccacgatgtcagcctgcacctggttttcggtgtcgtcggacggatatcctgttgtcatcactccttcatagaaggtgccctgagcccagttgctgttatcaccgccaatacctagaataatggcaccttctttctgcattgggttataatctccatttgttgggcggattccgctgtagtaggttgatagtgagcctgacacggagtcgccgccacggaccgcccattggttgtttgtgtttcccttgacaactgccgtgacaaaacgagatgtgatgctcgggttattagggttaacgctgacttttgagtctgtgtatagcccgttctcaaggtcagcgaggacccatgggccactgccgccacccacaccgtagccagtacccagaccaaagtagatagtttccatacgaccatcaccgttatccatgttgttagtctcagcattgccatagtcaaagcagcatcccccattgtagtgcgtgccatcgaaaacggcatacatgccctcggcctcatcacctacggctgtcccgttggcttcgttgtttcgatagccagtaccgggcgagataaacacgccgtatgccttctgaccattcaaggtgactggtgcgccaatagcagtgactgggaaatcgtagccaccaacatccccaccactggcagcaccacctggtggagcttgggtaaggtgactgttgtggccagactggtcatagatgacagtgatgaggcaagttgtcccgctgcagaaagagtcttgggcagcagcgtcggcaacaccaccagcggaaagcggagatatatcccgagtgccaccgtcagaaccacgcttcacttggtacagcgggcctgagtaggcactatagagggcacgagtggtgctatgtgcagccacacatggcgtcccaccagaagaatagatgtcgcaagggccggcagcaacaagacaccccgtggcaagcaagcccagggtgaatgtatggacgctgagaggcgaaggcattttcaaccacttcagcagcagatggacaagctagtaagcggacttggcctttggataggagtctcgtcccctgttcgacatttatggcctaatgctggctttatagacaatgaaattcgtcacataaaaatatggccgactggtgaggagatgtaagcttgctaatgctacctatgaatatctacttcctaaaacgagcagtcagacgatcatccaatacaactcagcccaacacccctgctactactctccatgaattgaaacccgatgtgggctaattctattgcctggaagaaggaaacgcgacccatgtgtgcatcctgtggagatcactctccccggattctgtcgccagccggtcatgcagcgccaacatgcttttcccaccttcctcatgctctgttgttaacggcacataatggttctccttcttgtctcggacaacggtcactatcctgtgattgtctccccagtaccctcgatttgtaagggcttgttcaagttatagccatcgaatacacattgttgtaaggccttcttagatttcatgtttgtgttgttcctgtaagtaaaagcattggctccaggtgctcctataatctgaaattcggaacatcacaccttatagtgcttacaggaggatgaatataaatagcacctctttgctcaagagctgcccgcgaaagggtccagtaagaaacccgttgcagtttcatctgaaaaactagcatatcccgagcatgtgcgagttaatcagggctccaatggtgggatcattatgtgggtattagtggtgccacgtctgccttaagatgcccaatccgtagagtgtcacggtcagaatcaggcctggtattagatgttgtaagcggatttcacctggagcgttatggtcagggccttaagagcttggacatttattacccttgttgcttaccaccaaacccctgtagcataatgatcagctgtgccgaagttccgattcccaggatcgcgcatttctgtaggtctgttgaccttcatttgcgcagaaaccccacatcatttggaccgaggtcatctctctttggcagatattccggataaagttgattggtcgggatattgtgagaatactgtgttcggcggggttgtcttcgggacttttagtttgagaaaaagtgtttatgaggagtccgccgacacatcatcatttcaatacaaaggtagttgcggaattctgtgaaatacctccgataagttgtggaatctaatgtttaggaagagaataaggcccgaactttgaagacgccatgatgggatcgaagttagaggggatgctggaactggaactagtcactggtgatggcaaggtgagctccaaatatgaatctgatatacttcgagcaggcgttttgctaatgaaagagggaaaacctatttggatacgttcacgaacaagcgagaactttggcatcccccgggaggcagaggaatctatggcgggtaaggattgtttcaattagtaagatttcttcatgtacatatcatcagtaaggctaaagatgtatgtctttcatagtgtggttatagcgcaatgtcttggagctgcacagaagactgtcccggatggcttttcagtccactccatgacctgctacttcctgttggccggcgataaccagatacccctggagtactctgtgcagcgtgtacgcgacgggaaatcctttgtcacgcggacggtagttgcaaaccaaaacggcaacggcatatgcacaagcaccctgtcgttcagccgacctggttcagcgggggaagaacccttgcgccatgcttccactgccccttcagggattcttccacctcctgacatcaatgtggatgcaatgtgtatctctttgagagctcctcagaccagccctgttggtatcgaggggaaaggggggagtcctgaacagaaacgtatccgttcctggatacgcgctccggctaaaatcttgaacgccggttctcaaaacgaagttcatcaaatgattctgggctttctttctgactggatatttctgcccggagttccgctcgcacatggcttgtggaaatttccggatgctattctctcaaacaccacttcatcgccattggatggcagtgatattggaatgatggccaccttgagccacaccataatcatccacgagccgttgctcattcgagccgatgaatggatgctttttgagattgaaactccttggtcaggagaaggtagggggttagttgttggcaagatacatgacagaaatgggactctgctagcgagctgcttccaagaggtatattcccccgtgtttcttcaatggataacaaaatcttaactccatcgcagggtgtagtacgacgcagaaagcaactgaaaaacagcgatcaaaaattatgagtatgcctaaggtttatagagtgaaggaagtccccattacgtctcatgcatagggtttgtcaacttttacaagcctttagattacactcgagcttgagttatttggaaaatagagagcagctgacttggaatagaatatcaagtttgggtaaatagtggttcagaatttgaagatttatggatgataatactggatagaagttattagaattcgtttagttttcaatcaataagatcgtatacctgagattctagtagcatagattatattacacatacatgcatgcaggttgaatgagaaaataacgactagtagagagcatcaaccgctggtatctcataagatttgtcacttcgacggccacggttagtcgtcgtttggaccaatcatccaaagcacaatctgcaagcctactaataaacacttagtataagattccagcaattaaatctcataccaagtaagaaagtacagtctatgaattccgtagaagctcgagaacttgtgaagaattccggtatcaaagactgtcttgcttcgttgtagtactaggtgcaacttcgttccaaactatcatcaaatctttgcttgtgatttatcgtcgactagattatggaaacttaagcctgggtttcctagaaatgcttcacaatatcgaacatgccatgtgcagcaaggggcatgatgttggtgggggctcctgatatcgcccccccgctctaaccatccgggattcgtccatacagcggcgcggaccatcccacgagccccgtccgtgtgagcaagcgagctggttatgcggagtagtgatcagtcgtgacccgagatctatatcatcgacgaccttggactcagccttctcacagagtttcattctgacatcagtctcaatttatcatcattaagtaaccggccaagatgggatactccagaaattgtgtcaagatgcgcccaaatcagctcgagaacatctaccagcagtacaagcatgacacaaaggcagtcactctatggttcgcctccacggcgaagatctatggctatccggaggacttggtcgcctccaaatcttggggtgtcatacactcgagactcgaccaattcaatgatgaaatacgcaaagaggctgctcatggtcgaaaggcaatgccactgcctcctcatcctcagagagaggaatacatattggccctagatgacatcctgccactggtccaaatcatcgcccaacgtaccaatcctgccgtcgccatgcctaaggtcgcagactcttgatagactcatttccctacgaacaaagttcagccagacgaagagcagcaccaaaaaaaaaaagcagatccagagtcggaaaagaatcacgggttctttgttggtgtcctcaagaacgtcagagaaactttgaggcccgtacaaaggttggggaggcggacaaaactcccaaggctaagtcgcaggctgctgatgaagatattctgacagatttgtaaaccgtacgatgaactttagtgaaattcttcttgacgtgcttgacacagagtgttggtctgcattatttggatgcagtcttcgcttctaatgcttcaacaatagtgtgggcgattctaatatacagaggaacattattaatatttttgaatttaatgtagatatctacttggtcgttgggcaaccgaaacacacttcagtcccaagcttagactatattagggtacattggcaaaagtagcctggaccttctccttattcccctctaagaaggcgtcgaaggagctcaagggaagtttccaagtcttcacatcttcaatatcaacttgcttatgaatctcctgcatagtaagctgcacgtagatgaagggattttgtttcttttgggtttcaatctcatcatctgagaggggaaccagctccagattcttgccagctgcctttcccagcttattcagtagttctccaatggggaggagctcatcggtgtacgcaatctccttgccattgaatctagctgggtcgagaattgccgcggaggcaaagatcccgattgtctttgggtccacgatcggaagggctgtctctggagatacgggagcgatccaacgcccgttttcggcaaggcctgggtaatgggcgacaaagggtgcaagaaaattcgtcatgaatgtcccggggcgcaagatagtaaaggtctggaagccagcgttgcgtacttcggcttcgatatcaagcttactttgcgccattgccgcgattggggaatcatgctgatcagcgacgctttgctgcagaaggtcgaagccgattccgctcccctgaactaaatgagagaccccggattctttggcgacccgaataataagcttggcctggcgcagttctccagatgggtctgagaaattgggcactaggtttaggtagagggcctgtgtgcctgcgattgcagtcttaagggcttcttcattgtcaaagtctccatgccaaagctttacaccaagagattggacagctttagacttctctgagtcaaggtcacgagaaagcgaatgaacagagacacccttcgcaagaagctctagtacaagcgctcctccctgaactcctgtcacaccacaaacaaagacagatagaatagccattttgattgatgcctgcagaacaatgtttggaacaaatgtgagcggaatatataacgattattacactgggacgaacacatctgcggtgttcgtgctgtagagttgcggaaaaggttgatgcagccttgcggagttttgttccggggtgagacgtgggcattcctttgcgacagggttggcaatccaaaaccccgatgctgttatgtaaatatgcagtactttggactagccgtggacaaatctttgacctgcgggctgatgcgaatagatacactcgtcaactaggatccagagaccagggggggggggagaccgccatgcatcaacttggcagatttggtcagaaagcggaataccttttcaaaagtggaagttgaagagtgaagacccaacggagtttgcggactaatgaccctctttaatcccaaagttcttattcactgactaggtaactacgggagttggcagtagaggttggatccccattggtgatgctcgtttccagcacactgccgcttcacaggtatcctgactacctacttagccttcttcttctataaataaaatgacacaaaaggagcttatcataatgctcaattaaaaggaggaaatagtttactcgatacgaagttctagtttttacccttcgctcaacatacccacttgcaatcgtatgcaacctacgcactgcattagaacccacttcctacatattatcctacagcttactgtgacgtggggaaagtccgcaggcagccacattcaactttagatccttgaagcggcggagatgaaaatttatggaggaaatcctaaacggctcttcatagattcaacgtgtataaactacatgccgtagctaggaagccctctattatttcttaaactctctaattttgtaattaggcgcaagcacgattatttagcggcctcctcgcggccttgaaggttggggtgagctgccttgacggggcgggtgacggcgtaaaaagcaaagccggaagacttggtggagaactgttgggcggttagtcatacttctagtcacaacgaagagagccattggacgatgataacatacctggaccttggttccgacatggaagaaggcgaaatctccggggacgaggtggtgggtgatgccagtagcttcatcctagatggatctattattagaactgctctgacggagtattgagaagacattgatacatacaaggatgtcaatctggccctgcaggatgtacttggtctcttcaaagtcgtagtgagccggtcgagaggggcctgcctcgatcttgtagaaccctgaggtgaagtagctgggggtgtccttggtatcagtgcggatggagtggaagtctgcgacggtggcgttttgaccggcaggcagagggatgaactcagagccagcgcccttgatgacggtgagagggacgagtccagacactaatgagcatgtcagaaatttccagaagcaaacttttacttgctagctgggggatctagtacttttgattggtgtttaaagtatgggttttgtagctggttcttgcgtgtatgtaatgatgggatgggatgcagcaagagtgttaggatcggaaaccctctccattatataagaaaataaatcaatagataccttatttcttttagagtgatgctgagacaggcatatactctaattacagaattggtaagtcaccgcttgggatggtataatgatgaatccattcaatcacgacctcctgggacatctctgccccttgatcaccccgcgattacgaattccgaaacccgagatgtacgcgcaagatagatagcagcctcattttgagtcatttgaggtactggagagagatctcgcattgtggagctgctgtaacctgcatacaagagccgccgtagtgccattccgtgcttgactagcctagtatttttaggaaagtaatgccataacatgctggaccatccatctagctataacttgcctaatttaagatcaaggtaatgccttcttgcgcgcttaaattgacttaatgggtagccctcatgtggattgttgaggagaatgttcctcgatgacagcctgaagggttctttactctatgtttgggacttaacccaattctaagacgaggtcagggactttctttttctttttccttcttttacacatatagacgatagtttgttgacaacggcaacgagggaaaatggcgctcatgaacacgccagtggtgaaacgtcgaccaagtatatgctcaccataaccgcggtctcgctgtatttcattgaccaagatcagtcagctgcttaagcactatcacgaacacaatgtttaatctcaatggaattgtcgaaccttacagtttctgggtggtctatcatgaaactgaacttccccgatcggtcgacagctacgccattgttgaaagcttcttactcgaaatgcactactacaagtcttggtcaacacagccagctgtgcgtaagtctgtggggttgacatgtgtatcacgatggacacgtactgttcagccatcatcaaatagctaggcatcgggtcatatttgtcacatttgttgacactcaacgatcacctactgtctaggaaactggtcagcccgtcagatctcccgcaacatccaccaaacgttacctcatagatattgagtgtacaattatataatgcctcagcaaatcacagtcatctggaagttttttggggctatccagaaggttggtggcttgggaaagcaaattgcattggctggcgggcttgtgacataaagcgcccggccaacaacatatgagcgagtgggtcgtcaaatgcaacaacatagctattctatttactgggtttgagcatgtgctttaactccgaggccaaacaaatatatgattactgatcgtgttgagatgatccaatggtttttgatggccgtggaggccggatgtcattgcaaagggcgtaattcgggttgactcgccaggtgattgaagtatataaggaactctttcctcagattatttgagataagaaccaaagacactcacaaacacactactttcatcatcatcatcaccatcaccatacacaatgcctctctggaacattttccacaccgaagggatcttcgagtcacaagaggtccgaagcaaggttgccgccgacatcaccagcctatatacatctggcggactccccagcttttacgttgttgttcatttcatcccccttcctccaaccaacgtgttcgttgccgccgaggcccgaatcaacaaacccttcgtgcgtttcgtcgttgaacatatggctgttcacagagaagaagggcccgaaggcttcgctgagcgtttcagtgatcgcatcaaggaggcgcttcgcccttatattgccgagaagggatatgactgggagatcaccatcgccgacactccacgcgatttctggaggttcaatggcatcgtaccaccaccatggaggagcgaggcggagaggctctgggcgcagactggccgacctattgagtggaagacggagtaggtggaattggaacgggaatggggggggctagctaaagctcgatctgagaagtcaaactgacggtgagaacttatcgcagggcagatcataagcatctaaatgttatagaacttgccctctctggaattgcatcatgggaaatctttgtgaaataagttcgcaagttcgctttaaatctatcaatatcctacccattcaaatttcagcaccggtcagcttgaaaaaagatttttttgccatgaatccttagtcgaccagtgaagcagaagaagaagcgagtctcatagagcgcgatgaaataactgaatccgtgcaattcatttcaacttgtgaaatgcttgtggttttgtgtttcatcagatggcaaattgatattcagtcctaaacattctagattcactagagaataacagctcttatagaacaactcctggctcgttgtccgtcttgggatcatctaggccagtcgtcggtgctattgttggaggtgttattggaggaactagtctgatataaattgattttgaagctatgataagtcttacgagcgacctgatataatccaatgacatgtgctcgccttgtgtcaggagcgtattcgcttagttcttgagcgtattcatcatttggtggatgcgacaacaacccgctgcacagccaccacttgcccgccaatgtaagccatcccgccgattttagtgctcactacgctaaaagtgctcctcttggacctgctcaatacgctcatgtcatgcattcggccattgcgagcccaaaaagctacagtgaagccctcctttggcgtatcaatcgccgtactactaagaccgcacgctggcaacgacaatacgtaagtggcgcatgcaacattcagccttgctgtgcccccagtgtatgatggaattagcatgagttggatgtaaacatgagattgagttaatggagaaccatttaatgcgttctctatagaaaggtttcaagaagtataagaaagccgtcaacaagctgcattctaccatctattcagcacactacatctctcgcatttcttctcaattctgttgttgaaaagttccctcttcattactcagatcgtttctttgagaattaattcaattcaattcatcataatacctccgcatcatgggttcatccaaagcttcaggtctcgccaaggattgcgaatcagccgcaaagactctgaaaacctttatcggtatgcggctacaaacagcgcttcacttctcccagcactgtctagatttcctcgttgctaacaagagattagacgaaggcaatgtccccaaggaagccattgctaacgctcaaggtctggcaatcttctccggtttccgggccgcgatggcttttgccggcagtggtggctccggtattgtcattgcgcgtctcccagacggctcttggtcgcccccatcggccttctccgtcaaatcgggcgggatcggccttgcctacggactagatgtgtacgattgtctctgcgtcctcaacacaaaggcttctgtagaggcgtacacgaaagccgagatggagctcgggacaaatctcgctgttgctgccgggcccgtcggcgccactgctcagatcaaagagctcaagcccgtttggacgtatacgagaacgcatggtctctatggtggcttgactgttgatggaacctccatcaaagaaaggccggaacgcaatgccgaattctacggatcaaaagtcactgccgcccaaattctacatggtgaagtccaggcaccagccgaggctttcgaacacacggcaaagctagtcaaggtcctgcaatcggtggagtaaattggttttttagggcgctcagctttcttcagaggagcactgacccttgctctcattttatttacaaccacttgacaaaagtcacgaccaaaacgcgaaaaatgcaaaacatgccaaccaaagggtggtcagcaaatcgcgcatttctccaccaataataagccaatttgcgcgatttaaattgagatcgattctctattcatttctccttccgtagatataattttaatactttgtataccacccatccgcattaattacggcctgcagccgctccggtattgttataactagttttttgagtatctcaggttccaactcctcccacaccgcaacagctgcttgaattaactgttgctttgcttcaattgttttaggaagagatgccaaataaggatattgtatatggattcgttatttgaggatattccataagttctcgatcggattgaggtcagggctgtaggccggccaagtcagcagctcgaccccattctcttcggcgaactcaaggagccattttcgaactatataggctctgtgtattagtacgttatcttcttggaatatagatcccggagagataattattagaaggttttctttataatattcgagtattctgcgtgctgtaataccgccacgcttagattcagggtcaccgagcagcggtacaagcgataagcgattataataggaaaaagctccccaaaacatctgcctataacgagtaggctttattcgaggttaaatatactccttctgaagttagtgccctgcacagcaatattagtaaagttattaaggttagcacaaagcatacctctcggcggaaaatatacttctggcgctccccctgaccgcgttaaacagtcgattcatctgaaaagaaaacacaccgctaccactctgcaggcttatttatatttgcctttgcgaatgctagacgggcctcagctgcctccggggtcaggaacaggcggcgcgcagcttttgggtgggagataccgtgttttttaaggtagcggataagagtacgctcgtagtacttaatcttcatatctaataaaatctgtttagttgatataaaagggtctttctcaatacatctaaagatatcatttttatcagaattagttatcgttaagggcctgccagagcgtggcgaagatgcggccgctttttgaacacgatatcgcgacacaattccagaaaccgagttcggggacactccctctttaaatgccaccacccgggctgttagacctaaattatagcttgttgtaatcctcgtacgcttgtaagggctgtattcaagcctcggtatcttcggaatcattattgttgaatcatttaaaaaggaagaagttgggtcaatttgtcgcgtggtagaggagacgcgtttttataggcccctggtcgtcacttttgtccacctactgtaccttgttcactcaatgattagctggctttatcttggcctcattcgcagttaccctatacctctggctctgcatcacgggtaatgatatggctcaattatctatagacttatatatcgtgcattggttttgttatatagtatacgatacttttaaatgcgtattcaagttcaaagaaaataaggttgtgatcaagaaatagttgcatcttgaatctagaactggctttatgttcttagccagttgaacttgaacagagtcttctgggattttaaaacaaaggagcccagtggaaatcttatatatctttcctcctcttattccttttcattattgtttttctacatttctaagcatacttctaccacgaggcatcatcaccttggtggcccaggaataacgctcttcagatttgatgctattctagaccctccgggtcgaatgtgccgagacttctagtggatctcgaatcctcaactccgactggccaattaccgaatttgttattccctgggtttgcgagtcagcggaggcggtgtgccgaggaccgtgaatgcattcacggtctcatttcccaaccgtttgtggaaaataccgctcctttgctctgacagaaatagccaattcaagacaaataggaatccgtgatcccatcattcaatcttgaatactcgcttcttctggtctgttgcgaccaggctgatcaatatggatgttgataacccaacttggatggatgcatccgagctctccgacgaagccaaaagagaattcaaagaatggatcaaacagcagcctaccaaactgagtatggatagagccgctgactggtttctcataaacggatataggggatttacgggcggccacgagcagcttgttaatgaggctctggaagaggttgcccaggagtatgaagccagacgcaaggtattgtatcatcactcccttagcattcaatgaaggcctgattaactcactattacgggaatagatgtgtcagtcactggaagttcctggatttgggcttccgctcacccatatgcctcccgaagatgagcgatttcccgtcttgttgggtgtagagtcgtgggattggaaagccgccactctgcttgtgcgcgaagtttgcatgatgaaagttatggaggagttgaccaacaaacctgagtggtggctgaagattcacgaccctgaaatcaccaagaaatggagaaaagaagttttggaagtggattgggctgcgtaccgcccgtacggtgattttacacctagaatggccaaggcagtaagtgcatgcaccaaaagatcattaggaaacgttttgacagccgatgtacagtgcatcaaggaactgcaactcaaggcagagctatatcaaaagacgggtctaatccccatcttcgactactcttcctgcgtcatcaaatccgacaacctcgtgccgaaggagttgcgcgacactcttcgatctgcggttcgtgtattggaagatgtccctgattctgagaaggactggcatcctggaactacccacaaagttctggaccttgtccatccttccctatggcccttgatttacggcagaagccgcgtcattcgcgacaaacgcattggcgtgtcggacgcgatcagtcactgcggcaccggcgaagttattcccaagcctttgttgattgaggtacctgggccgggtgatcgttgggataatgaatctaccgtgccctctgtttcgaccaagtttcagtggctcccttgcgacgttgttcttgatggccagtctgctaagatcgacagctacatcaacaatttgcacccggtcaaccacgcgaacttatatccagtgatagaaaagttcatcgaaaaggcactgcctgcttgggatgtgatatacagatggccaaaagagtttgagacacaacgactgactgagactaatgttaacccggagtgcgaagcaaaggatatatgccaatgggaatgccagccttataatcgtccgctggaggacggggaggaggggaatgagaatgatcaataccaacccggataccgtgagtctgagcgctttaagcgtgactgggcttggttttctaagacacacccggcccatctgccagagccagttccaggtgccgagcaccacctgaaattgtcggcttcagacgtcaaaactgagggatttttcaatggcaaatcacgcattcaggtgattgtgaagcttgccaatgttcatctgacccccgaggaccctgaatacaaatacgaggtctccgaggagcttgctaagttctacacgacggagccgcctgaagcccaggaccaaggctcagatgcatcttcgttccaaccagccccgtctgaaggttctccgtctaactctgatgtatcgtctaccggaaaccgtcctctttctttgaatctttcagattatcacagtatctacgttgataacgacacaacagagtatgaaggaggctcctggcactcagaaggcatgcttaatgagcgaatatgtgcaacggcattgttctattacgattcggaaaatatcaccgattgtcatctggacttccgtaccgcggctaacagagaagacctatcgatcaacctgaattatgggcaaagtcagcactacccaatcgagcagacctttgctattcccaacgtgaaccgggacacacttcagtacattggcggagttctcacaaccaacagcccatctactggcgaagacgacacgcgcgctgtgttcttccctaacctgctacagcacaaggtctcgccatttcgccttgcggatcccacacgacctggccatcgtaagattcttgctcttttcctagtcgacccagccatcccggtgatctcgacagcaaacgtcccgccccagcagcgcgattggtggggatgtgacgggccgatcagggacacgttgacacacaggctcccggctgagctgacgcagatggtgcttgatgacatagtcgagtttccaattgggactgaggaggcgaagaacattcgtttggaactgatggacgagagatcggtcaagcaagataagacggaggaaagtatatcctgggtcgggtggaatttctgcgaacactgagttgagtctggagaatcttaaatgtttttctttgaacttgtcaagtacctgaataataaatacagaggatattgggtcacttttgagttgcccttctgggcttaggatacatctcacttgagccagccctgtagtacctgttttacaattacttgaggttctgcgattcctgaagcagggcgtgtcactagtaaagaggatgtttgattttgtgttcgcaacatttggtataagacgctctcctcgatccaatggtcatcagtcagacttgtaagatgtcgcttctgaagttatagggttctcaaatgagatggttggtcccagtcgtatgagtctgttgggaaataagcacggctgccaaagtccggatcggacagcttctccgactttcgcagaaaagatcctgggcagagagttcatggtatcggacacttcgccgccagcgatcatttggctcagtcttgcgttgtgctgttgttagtttggttagtttagccgccctggcatcacttggagagcttctagccacaaggccgatcttggcgagaaatatgccgttaggattcattcatccggtttgtttgtgaatcctggtatgatactaatcgggttgataagcacgtgtgggtggactcttactcggagaccaaaactgacaagatccaatgaaatggcatcggatatcagtaccccagctttctacatgacaccgctggtacagaatgcgccatttacgtaaacttggccaatcgtctctcccctacccaccggactcctgataaccggcgccgacctttggtctgtggaggagctctttggatggacgagccacttgaccagaggagagtcggttagcagcagggggtaatcagttcccccaggtttctttatctagcactagagcgcaaccctgaaaataatgacgcgaaattcatattatctaccttaccccgcctcgcctcgaccttccttgatgttagcagtcgtttggcagccttctgtagttcgcttcatggccattgccatataaagaggcccagatcctacatatcgtagagtagagttgcatcacatcttcattgactccaagccttctgttgaacttgctgtgctccgtaatttagaaatggctcaagacaaacaggacaagcccccaggggtctccagtcctgacgtggacacaggtgaggtggcgccagtcactgacgatgccgtactccaagaagatctggacctggggaaagatctttcaggccatgcggactaccatggaattgataccacacaagtgcagcctggtgccgatgcggtgtatgaagccaagatttccattctgaacgaggctctcattgatatcggcatgggtccatttcagtggaaaatgttcatgatgactggcttcggatggtttctagaccaggtatgaaagccctaaatgacaacgaatggaatagcttgaagattgacagtcattactacctagctatggatgcaagcggttaccaatatccagcctcccgtaaagctagaattcaacgtcgagcggattgccttcttgtccgtcgccaagtattccggtctgttggtaggtgcctcgttttggcccatgaccgccgacttcattggccgcaaactcgccttcaacgtaactctccttatcacttctatcgcaggtctcgttggagcgggaatgcccagttttgggggaattgccacgctctgcgccattgttggtttcggtagtggtggaaaccagcccgttgacagtgccattttcctggagtttatcccagctacgcatcagaatattctggtggtgcagtctggtttctgggcccttggtcaagttgttgccaacatggttgcttggtaagttgatcctgattcattccattggaataaagaactaacatgagattttgcaggcctttcgttgctaacttcagttgcgcgtccgccaaggactgcagctttcaaagcaacctcggatggcgttatgtcttctggacccttggcgtcggaaccatcattcttttcattgcacgtttttcattcaggatttacgagacacccaagtacctgcttgggcgaggtcgcgacgacaaagtggttgaagtgatccacaagatcgctgctcgtgacggcaagacaacctggttggagcttgctcacttccaagccatagatgctcgtcttgctgcattaaacccggaggcaacagctgagactgacgaagatgttaacaagacgactctccggcgatcgctggacaagtttacccctgacaagttcaaggccctcttctccacccctcgcatggcactctctaccaccctgatcatgtttctctggatggccgttggaatggcgttccccctctataacgtcttcctacccatatacttgcaaaaccgcggtgtagccactggttcgtcctcgttgagcattacctaccgcaacctgacgatccaggctctctgcggactgcctgcatccttcctcggtggctacacgtccaacctcaaccgatttggtcgcaagggcacgggctgcgcagtgtgtctatgcactagtctcttcctcttcttgttcacccgggccgagacgcaggcagccgtgctgggattctcatgtggtgtcgctttcttccagaacctgaccttgggactgttgtactgctacacccctgagttattccctgcgcctatccgtggaaccggcaatgggctttccatgctgtttaaccgctcggcaggacttggtgccacgctgattggagcgtatgttggattgaacacaagtgtgcccatttggatttctgcggcgctgtttgctgtggcgggtattgtgttcttacttttaccctatgagagtcgtggcaaagctgcctcttagtttatactagcccttaagtactatgccatgtagaacataccagttatatcaggaattagatcctcccgatcatctgtgggagtcatgaaaccatcatgtacgcctgtgaaactttgtgcactggaaatccaacatgctagtacgaataaggagtctggcctgaaatttattaggtgctttaacaagggacgcaatacaactttgagctgacgacgacggctcctgacatccgccttggtatcatcaaccaatccggtggccttgttgaaccacatgggaccacggttgtaaattgatcgatgaaccaattaaagtctataaaacaaccaccagccaccatgagacgactagcaactgtcctcgaatctccctcaggtgtcatttgatgtagtcgcgtacaaattcacgtccatcctcgtgcttggtttgactggtacgcggcccaaatttgaagctcgcgatccgccatgtcagagtttcaaccacggtaagtattattttctctccctcttccagttgttacggaggtgttacagagaaaatactggccctcaaatctcgtgcatagaccatgtagattgacagttcgagcagcctgactggtcggtcggagacctttgagcaacggcagtatgaggaggagctcgccaagaagctgaagaagaagccctatattatcggaccgacgccaattcgtgagcgcttccacgagaactttcaggaagatgagttggaggaaacccagcctcaggatctggaggctggtggccatccaaccggaggccatcagcgcggcaagaagaaaaggaagcgagccttcttctggagaaaatggagggctttctgggaaaaggtcatcaaacccgcattcccggaggcgattatggacatgaagatcttattcggtacagcggcgcttaaggcgcgtctcaagagggagagcacgaacgcgacgcttcacccagaaattgcctccgtagcggaggtgaggcgagggatggaactttgcccggaggaacagcgattcctacggaacaggagggagctcatgaggctcgccttcgcaaaatatttggaccttgacccaaacgatgttcacccggatgacgtgccagtcatttcgtttggaggcagtggaggaggcttccgcgccctgatcgggtgtcttgggtatatggacgcgatgaagcagcatggcctctgggattgtcttgcatacacatccggtgtctctggttcctgctgggccctcggaatatactacaccattgctaactgcaacatccaagccgccatcgaccactgcaaggcaaggttctatccttatcatcctctgtccagcgatgccatccgcgccatcctcagtacacagggcggtgcaaagattactcttggtcccctgattcagaaacacaagagcgggatcgaaacgcactctatggactggtactcgaccttcacgagcgggtacatattcttccaaggcgaggccaagctggagataggccgcatcagagaacgagacgccgctacatcgcaggcaaaatggcttaaatattctgatgttggtaggcacactgacaatggacatgagccgctgccaatcatgactgctatccggcacgaacgactgtctgatcgtgcaaaacacggctcctctgacactgcggagcttgctgagagtagcagtgacagcgagactcccaattcgtggtatcagtggtttgaaatgacgccttatgaaattgggtgcgatgaaatcgaggcctgggtcccgacatgggcattcggacgtcctttcagccatggaaaatcaaccgtccaactccccgagcagtcgctatctatggttcttggacttgcaaccagcgcccccgcggcccacctggcatcatacttgtctaccattaatcggaatctttcctatggattattcgggacctccatccgggagattgctcgtacgataagtaggtggtggggtgaacgcggaacagagcaatttgagaaccatcacccattgcacgcttgcgaggagcataactatatgtaccagtacgccgaagacgaccagggaaagaagaaactatccggtttggagagctcgcggacgatcgagttgattgatagtggaatggataataactgcccgacatatgttctcttgcaccctgcaagaggagttgacatcatcatgaacatggacgcatcaagcgatgtgttgaatgacacattccaggaaagagtggatcaaattggaagtcgaaagggaatgaaattcacaaaacgagataccgacttgattaatcaggttcatgacaaccctacaactgaagaggaggaaaaagaccatgcagctgaagtctcaaatcctaccgagcagcaagaaaatactccagaagaagccaacaaagaagccaaatgtgataaaacagaaaaggaaacagagaatccctacaaaggaagatatgcacaaatttatgacggtgtgccgacggaacggcctgctacagtagtcaactcatacggcaaaaccgtcaccaaccccccttctccagtcttcaccaaggaatcaactatgatatacatgccaattattccaaacgaagaagctgtcaaagactttaatccatcaacggctaaattctcggggtcgtacaacctggtgtggactgctgagcagatcgacatgctattggatctctcaagagcaaactttatcgctggcgaagatgccataaagacagccatgatggaggcgtggcagagaaacaagacaaagagagaggaattgcagttgaagaggtcggatctagcgtaggccctcagaaggaataccatttgaacacaagaggtgttaatcactgtcatctggaaatatcattgggaaaacaaaccccgtcttgctttcttagaaattttgaacaattataatatgccagcaggacacatgaattaatgtaatgatatgttcaaggggagcttatattctggtgacctattgcgatggcacttaccggtgtttggctatgactctcaacaaggggcaattctcgccatctatgttgttagaaaaattgtacaaaatcctaaagttccctcaaaggctccatttactccttttatgtttagaaagaagcagggatatctagatcggcaagataaatctggattttcgtggtgtatttgttgattattcgcgtcgagcccctcaaagatccaccagattactcctaactccttgactgggtttagttatcagaaagatacgagaacctactagaatcttattggctatgaccccgctcacgccctgttgcgcgccctactgatcaaaacatgacaagtcaagcagccggcttatttggaaccttaaaaaattcagtttgttcgcttatacaaccgctgatgctccaggtaacaccctgaaactactcttgaaacgattgtagtcagtctggttctgaaagcaatactgttatcaaaatgggggaggtaattgttcccaaaaaattaccggacggttctcatcacgttgttgtaaaactggaaaccatccatgttccggctacgtcggttgacacgtcaccattctctcacgagttcatctcctatgagtacacgccaaaagaagataccgctcttgtggcggagagaatcaagtacgccagcattgtggcaacgactacagtgccgataaatgctcaaacacttgataaagcgccgtacctgtatgtggttcgaaatatgaccaacgtcatgcgctttcactaatctcacgatagaaaatgcgtcataactgaaacagcaggcacaaatcatattgacgtcgaggagtgtgaaagaagggggattgctgtatactcggcgccaactggagcggcggatgcagtcgcagaacacgccctcggcttggtaagtcctctttgttaacatatcccttcattggagatctaacatgaatgaaaatagtattttgccactcgacggagctttgtgtcacttcataacgcactctatgactatggcccctccaagactaatggctggaaaacaaacgggagtctgtcatctcttattaaggatgccaaggggcagcctccccgtagcagcaagaatgaaattgtgggcatttttggatacggagcaataggccagcgcatatccaacctctgcaaggctttgggaatgaaggtcattgtggctggtcggaaacactcaacgagccacgatgatcctactcgcgttcccttcgcagaggcggttggtgaagccaccgttctgttcaatatcttgccatttctcccgcaaactcatggcacatttggtcccgccgaatttcagaagatgagatcagatgccataatcattaatgtcggacgaggtggtactatcgatgaggcggctctatttgaagcactttccaagggccaaattcatggagcagcaactgacgtctttgaaaatgagcctgttggatgcgcagaagatagtattcttcttagcgaggaggcgaaggggctgaatctcacactcacaccacatctggcctggtgtgctgatcagaccagtatcaatctccagcaatcattgaaggacaatgttagggcatatgtagagaagcaagtagcttcaagtacctaatcataatgaggtaactcctcaactattgaacgttaacgaaatggcatttcccatttgcttgaacgtacaaactctgacgatatgctataaaattatgggcacttcatttccgatgccgtcagtaggccaaatcgtcatccgaaaccgcttttgtagatctactttgctgtgcgtcactgtcggttcgcattgtctcacacagcgtgactcatcgtgaatccctgctctcgggatgagactgccgacagccgagtgctatatcactcgtctcgcgtacgcaaacattgcggcatatctgagacctccatcattcttctcgaaaggaaatccccggagtaaaaatggcgaatcagcctgctcccatcaaatccctactacgaggtctccccgtacttcaaggtgctcaccacgagtccgcattggacaccctgggagaaacccctcatgcagcatttcagaagtggctcagtgatgcaattgaggcaggcgtcagggagccacacgccatgactctttcgacagtagacagccttggattcccagatgcccgcgttctgatcctgaagaacgtggatgagcgaggctggcactttgccgtcaaatctacaagccccaagggccagcacatcgctgggaacccgcgtgtcgcgctgacattctactggcctgagatatgcagacaggtccgaattcggggcacggccttgagactacccgatgaggagtgccgtcaagactttgcgcagcgcccgcttggttcgagaatcagtgcaatggcatcgaaccagagccaagtgttgctggacgcgggagacctcctcaagagtcgcagcatcgccgaagaaacattctccaagaaccctgacaccattctaagtgattgggcggtttatgcggtaacccccatcgaagtggaattctggcaaggccaggcggatcgtcagcacaagcggctcaaatatgtgcttcgtccagacgaccagtcgtggggaaaggctgaactttggccttgaaaatatgttgtaggcttagcttcgctggagagaaaagatacggagtatgtcaatgtcgtactgctttgtattaatgagctcgtttgggggatcaaaatacaaaaaataggttgcccaataacccttattatgatggaacttagtacaatagatgcaaccccccttcaaaattcttctcttcattgataggtgccacttcctctcggtttgtccagatagcttctaagtcatagctataccgtgcaacttgtgcaaagctagtaacatcacgagtttgctgtagctgtttcctgatgagctgccggtcttcaggtaactccatcagcactcccaaggtatagatcggccactgcacgatgaagcatttagcccatacgttgtcgtttgcgtaattctcgaggatttgaatcgctaggttcatctgccaactcccacgtggaactgtctgtgggagtccagccaaagcgcttcctcggagaatttgaccaagtaacagggacgtaactagcgtaaagaggtggatggcagtcttatggtaatgttcccggatgtcacgtcctttcaggtcggccgggggataattcagaagattttgatcttcaagcagcagcccctcccaatcggcaacgtcgttttgtaagcgttcaagctccaagatttcgggaagtatccctgtacggaaaacatgccgaagagacaaagcaatccgaaagagagaaacagaaacaccgaggacggggctgtccgagctccctgaattttccgggaagaaactggtttgccccagaaccttttccgctcgataccaaaacacgttatcgaacgtgaagtcagagctagtcgaatctgaccaaagactcgccgtgcgaaggaatactgcgtacatgacgctttcaagtgatagcctatcaaagagtcgagaaacccccagaggtttgtttagcacatggagtgttagtagtctaattcctgcctgaatatgttgcggaatatcacgattagtgtcccagcccgccaactgataaattagtcaagttccgtagagctgtgtactcagggaagtaaacctactccgtgaagggataacatcataatggtcattagtaatccgtcgtttttatcatcttgcgagacggtagagagaaggcttgcaagctccctgacagaattcgtgtaataagccagtgccatgtatttcatattggaagaggcatcgattatcgacatatgagatgcagcgcaggctagaatagaatagtagaggcttttgtgagtttccatggcctgtcgcaactcagacagccagccatcgtgatattgagtgtggcagtaaggcaataatagaagagagtagaatttgttcacaaagtggcgagagatatgacagtccaactcttgtgagagcactcgttgagcaaccgcagagctggaaaactcggcacctgataggaatgggttgtgttggccatgagaagagcgacaaaaacgacattcttcatgcaggccatcgtgattcaatcctgaatctcgaggcgtggacagattatctcgatgacgtgattctgaatgagatgcgtatctgcgatcatatagatctgcaaatgttggccactggcaatcacggtgagaggacatacaattcacgcatataggcagcttttcgtcacatttcttccggcgccgccggccttaaatcccaaagtcagatcccaattcaattgtacccggagatagtaaaacttacacgtgagacagccggttttgctacgcaattttgtcttcccaacaacgttcatcgtgctttttgttagggaatcatcttcaacaatttggcaaatgaggacacgactggaagcggtgccctcggaatttaagaatgctatgtcggaatgtaatcagtggcaatctcaggtttgcggggtaaatgatacgtataagtaggctggttgacggactctccccacacacccatggcctccgcgaatgacatcgtttgattctatcagtagggatgggtggtttgactcgcatctcggaaagagataagaattggaagtgatagcagattaccgcaaccaataatcgtctcaaacatgggggctgccaagcagctaaaccctttaaacggggtgataacgagttcaggcatgaagtttgggacttggatggcattggctagcttgcggaaagtcccgccggctctatacacaatatgaaacccgttgattgattcaacgatgcaccttctactttgaaaggggtttcaaaatcacaatcacatactaagctatcgtcattcagattcccattgctgcctgtcacctttgaccaattctgcgtatgcctgagcactcctgatcctaaacatcttgccatatctaaccataatcaaaaaagcagaagaggctaccataccgataaacgcggcggaaatgaagcagttttgatatccaaggttggtcagccacggggtaatactatcatcgccgtttagtcataggtgtcttcaaaacgacaatgctggggaaatggcctacccatagctaatagcaaacgacatcgtattccggacaagaatgattgtcacgatggcatcgccactgatatcatggtagctgtcgataagataattcacactcagcgtgataccgaccgaactagtgaaggcgagacagcccatggcaaacaccagcccaaaccagtggactccgtgctgagcgccaactccccaaagtatcagagatgcaggcaccacgatgacacaaaccgcaaagggccacaggcggtgctctgcttccatgacaccattgttgcggcgagcgagtttgatggtcagccagtcgctgagtcttccggagaagattgcgccaataagcacaccgatacagcacgacaagtagctgagtccaaccatagatgccccgaagttgtagggatcaccagacaggataatagaggacgtagcattcaagacattaaaccatatcaaataagagccatatgagaagcctgcatagaagatgactggccagcacaataatttcaacgatctagcgacacgtcgaaccatgctttggccgggcaagggctgccacagtgacattttctgaagaaaagtcttgggcatggagtgaacctcgccattctcggcttgtgaggagctctcagcactgagatcgttcttcttgtcggcagcttgttcagtcacctgcggggtgagttgtattgtcgcagagggcatcacgggccggttgtagttggtctcttccataaagaggagcaaaaagacaaatacaaatgccagaaaaatggcgggccagtaaaagacccattgccagccttggtactgggcaatgaagccacagataatcggggtgaagtagttgcttccggcaagagcaaaggtatagaatcccatatatgtgcctcgttcgtgggtaaagtactaaagatggtgttaaaaagagactagttgacgtcagatgcagactcacaatgtcagtaatggcaatttcaggaagagcctcgatcggagcgatgaaaaacccttgcaaaatacacttggctatccactggccgttgctcgttatgtatgcactggaaactgtctgttagccaccgtgcactcaaggtttgtatcaccaacatgaattcaagagcagcctcacctccaaacacttgtaccctaatggtgagtagttagccaagtttaccgtgaacgatttgtagggctagctacgtacaattcctccaaggatggagacaagcagtgtcaggcgtttaccgtaacgcaaggccattggctgccagaacaagaggccccatcctaggaacaggaacatgtagccagttccttcattgagagttgcaatcgatactccagatgcctcggagagcggtacgatgacagaatacaccgtagaaacggctatacctgtgaaccacgtatacctgcagcgcgaggaatgtgagccatggcccaatctcaaatcgccacattgatttcgtcgacttacaagatttggcaggtaagcgaaagggtctttcggtgggcggaccaattgagagggtcattcggatcgttggacggggtcggattgagaacaatgtcatccgtagctgtagcatggcgggaatgtaaggtatttcccagatcaacgagatggactgtgcctggaaccgcgattgagtccgacattttgttggtttagcaatgagaaagaacagaatttgggcaatgaaaatatgcgtggaggtaaattggccatgtaagacgtggtcctccgtgtctttacatactttatcacctaacggacggccggagacttcgtcgtccagtatggaccttgttcggctcacttggagtagagataacgatttcaaatgcagcgaagatgttcccagaccgaccctccatcgatacaattcagacaatcccgctttcggcagacatctaatgcgctagtgtctgtccatcgagtggatcgcgtaaatacgtaggattggccagtttcctcgtaagtcggggtaaagtatcatgtggccaggtcggcaatgctcttgataaggggagggtggaggggttgggcactttgaccagtaagatctatttacgcccctgggactttggacattgatgatgctattagattccagctagtgcagtggcttttccccagggagccggcaggttggcaatgctattattgagaagggagagagtgcgggggctgagcacttggaccagtaagatgcatttgcgcccctagacgtcttagacattgaaggcggaaattgatcttcagctgatagtgaagtgacttgtccagagcgtttgtatcaaactcggaccagaggaattgagtaagccgtttgccaataggggcacgtatatatagaatttagcctgccatgtcatcagtgctatacggctgcaatccagctctggtttctttaattttgaacgtccaaaagccaaaatctcctaccaacatattgtctgtcttactccaaaatcatgagcgtcgcttcttgcctgccgccccctcacataagtggtcctcacgtaggggtcgaggagcacctactgcccaagtacccttcaaacataggccttcaaacaaccgatgcgccagtgagaaaacttccagttgtccaagccaagccggtccctcgagggaccgcaagctttgagactatgagggccgccctgcttgacgcttttgatgccaaagttccgcgagattatcatctgcctcgtgaaataatcgaaaatccgcccacaaatgtttcaggtattcctacatcttgtggaattttatcggaagatgaaattgagatcacggagaactatgacgccgtcggtcttgtcgccgcacttgcaaagcaacgctacacagcggttgccgtagccactgccttttgcaagcgagcaataattgcgcatcagcttacctgttgcctgacgtcttggttcatggacgaagctattgaacaggcaaaggagctggatgactatatgatcaagaatgggaagcctatcggccccctccatgggctccccatcagtatcaaggagcacatagccatccgcgggacatcctcttcacacggttactttggcggtatcggcatggacgatacagacagtgaaatggttgcaatccttcgaagtcaaggcgctgtcttttactgcaagaccaaccagccacagtcaatcatgcatcttgaaagtgactctcactggggtcgaactttgaaccctttcaatattcatctttcctcgggtggatctacagggggcgaagcagcgctgattgcgatgaaaggctcggtcatcggtgttggcactgatatcggcggaagcatccgaggaccttcagccttctgtggcatctacgggttcaagcctacatccaacattttgcctatgaggggctttagcaggggcacgttcccaggcgagctgaatgtgctggcatccaccggacctatgggccgtagtttgagggacatggacttcttcatgcagtctattctctctgcaaggccgcatctagctaatcctgagctgattccgcatccgtggggcagcattgaagccccgcttggccggaggttgaagattggtatcatcaacaacgacgggttcatcatgccccagccacctgtcaagagggcgttgtcttgggcaaaggccctcctatccgaccccaaatacggggatcttgtcgagatgaaggatttcaaggtctttggtgctgcagaggcctgggacaaggttcgattgatgtactggccggacggtggtcaactcacaagggatgccattatgtctactggggagccagtccaccccttaactaaatcgatttgccagacggctaagccccttgggatgcagaccgccggcggcgtgactctaatgcgagacgaaagagacaatttccgacatgcatttgccaagagctggacagagcaggatgtggacattgtcatggggcctgcgtttgttggaccagcgtcggcccacgatacagcattctactggacatatacctcgctctataatcttgctgattacccaggggccgttgttcctacgcctatcaaagctgaactaggagaagaatacgactccaactatgttccactgagcgatgcttgccaacatgtcaaggagatgtgggaaacggggaacttcgagggtgccccgataaatctacagattgtggcaaggagataccatgaccatgagctttttagggcactgaatgtcttgaaagatattttgaaccttgcttgagaaaatcactcacgggtcagtgtttcacggtgcagttacatcgtggcattatcaatttatcataacatgactttgaattgaaaactaggactctcgcctacgagctatgacgagataagaagtgaaataagagtaagaagaaaaactaaatgttagatttttcaaatttaggtaataaatatcgtaagagtgtttgaaaatagtgaaaagtcaatctgcccagcatcctagcttcccgtagaaacaatatgatatcgtcgtgagtcactgcccaggatcttgcccaggttgtcaagcgacgtgtgcaattggaagaataacgccgtggtttccggcttgaaactcggagcgtcgtcattatccgtgaaatgaatcttctggcgcagacaccaggccagagccctgtccttgtcgctgcactgtggagagtcgtccagcgacatgtagccaaggagtttctgcttagccattctctcgtcaaccatgtcttcaggaagaggtgctgagagatcaacgccgttttcaagaaggagttgaaggcagtctaccgtcgcattgacatgcctcatggtggtgctgtcgaggagacagttgagcagatggtgtagcagagtggaggcattctcgcgcatggttcggtgcgcgtgttccgaggagttgatgatggcggaaagtgctctgaagtttccaacctcacacgcttcagagatgtagcgataagcgtctatctctgaatcgtctcggagaggttgcatttcgagcatcatctccaagaactttgcagaaccgtccaagccttgtatagccaagtcaagaggagttatgtcgcgatacagggtatccccatcctcaagtcccgcgatgggcgggtgttgtggccggcgatgaatagacgcgttcgcgtccagcaaggtcttcaagataagttccttccggggaatgggccatgcagttcgacttataacatacgacaagggcgtgtcattggcacaggtcgcattggggtcggctcctcggtccaaaagggtcgtgacaagatcagtctcgtgaggcatgtccgtgaggagatacgccaaagcagtgcggcatctgcgagcaatcaccccttctgtgtcgtcctcgatgacgtatcgaacaacttccggatcctccatcctcacagcgacgtcccagaatccaagaaagtcatcattgtctaacgacagggcgcttctcgctcggaggtcctcgaagccggcgaaatccttctggagaagccggctgtccaaggcagttgtaaaagcaatatcgccatgatctgtgccccgcccagggttagatccatgcttcagaagcaagtctgtcagtgtctttctcagttcctgctgggcagcgtcgatattcacatcgtcccagagcatccacaacggcgccttagtgttgtccctcacgcggtttaccgaagcgcccgcctctatcagcagggtcaccatttcaacagtctccgggccgttgtatacgttgcacgcgcgggccatgggggtcatgatgtcctgctgtcgatcgccatcaacgtcggcaccagcttctataagacgcctcaccgcggcaagatttgcgctagcggcggcgaagcacagagcggtgttgtgaattgctccaaagtcgaggtgttcccgtgccgattgacgaaagtcgaggccttctttgatgaagtggtccaataacttcaggccgctgattgcctgggcttctgtacgaatttgtcgggtagtggttccgttataatcccaataaccgcgatcccaggagtccatacaaagctgatgaatcaagggcagccgaccttgacgtgctcgatcagaaatccgcggatcggatccaagctcaaggagtcggagacagtcctcaaatctggaagattcgagggtatcagccagtattgtggtgctgtaagtctcgacgtggccggggtgttgttcaatctgcctggtgcagactctgttaatgtttgcaccataatcaagcaagatggaagcacactcccagtttccgtgatagcaggcaaaaacaagaggagtagctcctcgggcgtctgccttctcaatgccacgtgtgcccttgcgttctatcaacatcctgagaagagagacgttgccagtgagagctgccacatggaacggggtcattccagtgcgaggtctggagggataccattcgaagcactccatatcggtatccgcattctgcttcatgaaatattcgccgacttcgagactgcccgtgcagatggcgacatggtagggcgtccacgaggggaagcgagcccaggggaagtagatgaacgatgatcgtactcgtcgagtataatcgtgaagatgataacacgggcaggcaccgaaagatccgagatctggccgagctccatgttggagcagcagttggaccatgggcaagtcgtccaacatggcagcgatgtggatgggagaccagtaacggggtctgtggtcccacgtctcatcctgcaccgtgatgtgcgatttgtacgaaatcatacactcttcgagcgtagggatgagttctattttgagtttggcgtcctgcttcgagtgccagatgaggttggggttgatgccaccggcaatacagtagttgactgtcgagtgcatgccatggctgacaccccagaagatggccttgaggccaatggcggactgggccgctagcgtgtagagctgtggattgatgatgcgatggagctgagtacagacctgggccagcgacgcgagatccgaggcgttgtcgatctcctcgccaatagcccaccaaatctcgactgggagacgttgggccatggctgtccgcgatgccgctgacgagcagaggcagggcgaccgacggtgcgcgcgacacaacgcgaagcaaagcaagctggagagcgcgagctgctgatcgaaggctcaagtgttgggcagcagctctcagctcatcgccgtggacaaagagggggcggaaggtgactaatgtgagacaacaaaacatggagccatcggatggtggcctaccctagacccgcgtgatgggttgcactcaatcttcagctgacaccaccaccacctcttgtgttgcgctgcagtgttgcgcgatattccgggctcagcatgttgcaacaccactggctgtccaatattgcactttcgataccacccaggcccacaccggagagcgactctatctcagaggttgagaggaggagtgcccatgcaacgtcgtaatctggtcatagtagcatagagtcacacacattgcacgtagatactaatacgtaagatccaagcgcgtaaaacttgattgttgttcatgccggtgagacattctcaagttaaacccgaaatgatacagctcgtcttcaggatttcgaagaccgatatccgaggtctgcgttgcacaacaccaaggaacatgaagcgaagccgacatgattcgctcgcaaattcaattgccctagatagccttcaaatttttcgtagagaagtaaatggtcaaaaaatattgattagttgaacctcgttttttagtgatacaaaaaagagacggccacattagcaatagccgtgagctggtctcttgtacttctccgatgattgttctctaccccattgctaggatcttggctgattgacttgctcaaactttgcgagatatctccacacatcgctttgggccattcagatcccaacctccataaacactcaagccttcttgccattcttgagctcctttccgaccatcttcttcagactatatccatgatattagtaccattcatgagggcggggagagatagacatacggagggagctttgactggtcgcgcacgaagccctccttgcagaagcacgcctcaccagccttttggttggtcttgcaggtaccgcagtactcctgactggacatgcaactcaagttcttcgggtgggacttgccggcactcttgcagactcccagagagggggcctattgctattgtgagtcacatgtcaagggaaaacaccgcggtttaatgctcttctacttacacgagcaagcaagtcgcgcgcctccatgaagtagtcacgagcgacgaggtagtcgtcgcggagctctcggacgatcatggcagggtcttcgccagcaagctcacgctcgtagagctgaccagcagccagagcggagaaggtaaagatggagaagatagccttggtgaagtgcatgttggtggttgaaaagacgtgaagaggaaaataggaataggattgatgctgaaagtattggaaggaaaactggaagtactgatgatgctatgagagtaatttcaagacgacagaagggacaaaggtgtttatttatctatcttttccgcagccttttcacttccaaaaatacatctttccattctgatgctgctatttattttgttctttccaggatattggcttccaagctcgaaggaactgaactaacagatgctgccagggtcaattttcatccttgtggggtctgtagggagggagccaccgagagcatcccaatccgctttccagaacgattccgcatgactccggtatgccctggcctcagaagattgccccttgctcctcgttgcgacaactgtcaaattccttgccacttgttcatgccaccttctggatgcaaactcaaggagggacacagacagtaaatctagggattacaactcctaaatgcgggccttaatgacaatgtgaaaccactgctgtgaccattctttctactgcgaccaattgaccaggaattgtcgatgccactgatcgcattggacaaatttcgacctcatcgtactctcgctgtgagtaagttgctgccaagtataatccaggggtagcttcgtaacatgacaagggcagaagcataaaaataggttacaggttttgagaacctgtctggcataccaatccaactctcgttgcctggctatttggcacccactcttggcatcgagcactaaggatcctacgcctggctgaccggtagttccgcctctgttttgtagggcctagactgtttgaggtctccgcgcggctcataaagcttgcgttcccagctcccagtacgccgggactacaatgtggacgcgtatggccagggagcagatccacccattcaggtcccgtttacgggcttcctttttcgggaagataggccggcatcgtttgaatgcaattttgggagctccagggatgtcggcactttgcccaccgagatggagtctttaatatcaacttgacgtcacgcttgatttgccagcacccatacattgcctagggttatggccagaacttgttgggcaagccaccagatccttatttcgcattaggatagacttagcttgcttagatgagtataattagaatggaatgtcactactgaaaccactgcccacttcccccttttgagtgtcgatctggctggtacacggtattcaccgcatataacaatattctacgcattgagactattaccgggccgttttggaggcgggccagcgagcacgaacgaccgttatgttgctgcctgttacgctggggtgttttctcagtgggccttcttagcccaaatcctttgctcttgctagcgtggttgttttattcgagatgttgttccaccttatctttaacctccttccaggttctgctgtggcaaactttcttctgaagtgtctcaggagatattgggtacagtgccttgatcctatccatcatcaccttaggaggttattgcccggcttcgcggtgtctcctgaaattctatccgggaaaatcatgtgtactatgctgtggtccgcctaaataattgttctgaggcctggaagcagaagacatcgagcttggacgttggcgagtctgatatagatggcaaggagagcggccaaggggattcggatgccggatttccgagggcttctcaatctactagctcctgcttgctagtcaagagggagacttccgggccttagaacctttggaagcaatgtagagtgcctattgacccttgcccaacctcgtgcgcctagcaatgaagtactccgacattgttcgtttgaaaggccatcccagtctaggtactgtgcaagaagtctcaggactactaccacatctataggggcatctttaatcgtgttatcagtgtgtggggattttggagttaaatatatgactggtcctagcgtcaagacgttaaggtggctttttagtctggcccgggcccaagttaagaggattcgattggacaccttgaaagcccagtatttcgttgacgaagccgactgtgaagccttgaagattcagcgtcatgggattaaattcagccgctattccccaggtatcttacggccaggcggatcctttcaccaagctgatctagaactttctgatactcggcgccccattttgagcaagcgttataacatctgagacgaccaatacgttaccaagacagcaagtgtagcaagtgtagccggctcccttaaacctacaactcaagtctcttaagcttgccaagtctcagatcacgacgaacaagacgcgaagcaaaggacggatggtgaggatgtcaacacaaaatacatcagactttcagcctattggctgctattatgaggacaaattgtcctgacttagtaactatcagacactgatgctataccctactgatcacaaccgaagtcagaactccataggagctagacctcctaaactataaataagagggcttttgaggtagcttgaccacttcttatgatttcttgtggtctttcgttgtagtgagagctccccttagaagataaattcaatgcagctgttcgaatctattcctcttcgttctctgactcgatataaacccactggtcgacccaatgcatcctcgctagggcttctcccgaagtaatgcgcttctgtggctcatactgcatcagcccttccatgacactcagcagatagctaagcccttgatagtcatcttcgataaagtccggtttttcaaagtcttcatctttttcagccagggtaatgatgaaatgtcttcgctgctcaaaagtcttacgtaaaggctgaaagcgcggttctcctctggctagaatatagtttagtcatacagagaagcagaatggaacgagaagagaacagaactcacgctctggatcaaagccgggcttctcttgaataattttaatccattggtcattccacgctgatggaagtggccccattactagagtcatggaattgatataatcctgcttatgggaagtgctgccaaatggtgcttgtcgatagaatagttggtaaatctagtgtggtgagcatagtgaattgtaggaaaccaagttgcaaatgtcttaccacgcaaccggctctccacaagtcatgtcgatggtcaaaagagccaatgaaaaatgtctccggagatcgtaggtttaggggttgggaaagtgctgaaactttgtcgttcgatgaaaaggactccccccaatctatcagacggatactctcctcgggacaatcaaaccaaccgctccatgtagccgcccgcaccaaatgcttaggaaggcactcagctcgcggctccgaggctgagtattctgcaacagtaggctcgccacccagcacttctatgaggtcctcgtcgtcaatcgcagtttggcaggtgaaggaaacattagaaggggaaatgtctaaaacggatcaataagatggcttagaacgagaagagaaagatgggtggggctccatgcctccgtgaacgatcccccagagccttagggtttcaacagcttctaggagctgacgcgaggatctgagaatggtatctggtcggaaggtttcgacctcttgatagttagtgtcatcccatgggatcatcgcatcaaacactcgtatcatctgtgctatagatggcccaagaagctcagtcacgagacaggtgtgagttccatttgggccaatgtgttggaagtagtgtatcaggcgactaaaacatcttggcttagtaggatcgtggattgtgtatttgtgctcgagtaacttcagggctttgacctccggatcctgctcaatatcgtccaaagatactttggcttgcttaatctttaaggcgacccattgactagaagagagttgaaaagacgttagcagtggtcagacttcagaaccgatcggacgtcgtacttttcgcgatcatcccttgccagccagacagttgcattgcccccaaacccaagtttatgccttacggtatatcttccgtcagagaatctttcacccagagtcacagggtggaagccgtttcttagatacttctcgagcggctcatgtggaaagatcttcacaatctcctcatagcggtcatcccacccataacctccggtattgtcaggcaatggcgccctcagcggcttcaaaggttcagggtcttccgacatgacacaatgatactacgcgaagggtcctggatcaagtcaagcgaagagtagtaatgatttattgtccgttgctgcatgctgacagttctcagggcaaaaaaaaaaaaaggtacctcatctggcagcagtctccactccaaattccgcagcgatgattaataagactgaggataaagtaaacaaataaccgaacagaacgttacacatctggagtaaatgcatgttgaaggatggcaagatcgttcggattcccccccccccggcgtaaagtctactttctccccagtcgcccctggtgggaagtgaagaagatagtatgagatggagggttgagttatttattggagagtacatttctgtgaaagatacgtggctaaagtttctgattgcaccaatttacacccaaaaaacctagatttccatcggcttccttgattactgacgcgcatttggaacgatgcaatccataccatacccatttatgccaaatcatattagtaaacgatatgatgtaacgcagatttaagattggaattctgaaatatcaaaatatgtacggaagtgttcaattccggtcgcagtaagccgcgcaaaggggctgtacgctgaccaaaggctgcggcacagactaggattgtggcatatttttaaatatcttacctaaactccatcaattgtcgcgagattagcacccagaaatagacccgatctgatctgaatgtcgatatctctatattagttgcaggtcgtccttcccgggtcctcgatagaattttgatatctgcccagcaatcaatcttatgaagccgccatccaatttcatcgccattcattcaatatattgtgcccgctaccagctactttacacaaatttcccaactctaccgtcgaaaatccagctcatacgcaaagcaccgtcaccatggtttgcctcaagcctattgccttcttcctgttggccctggcatctaccttgttagctgcccctgcaaatccggactcaatcgcgtctcgaaatgacaaacaatgcggccgcgaagtctgtggcccgagtgaacattgcatccgctcaaaaattagggctgtcgtgtatcggcgtttaaaatgagggaaattcggagcatggccgagactcgatatattgcttcaaattgatatgggtaacgaaacaaattttggatagctatggcttggcgtattgtgaaaaggatggcgctttatgaggccgggacaaattgtttggcgttttggatattggcgacttctgagatgggtttggggattattcttggtacaggcgttacaggccgtaaattttcagttctgaggcatttgccttattttaatgctatagctaaatgcgcataatcttctctcttcttcaactgatcgtggttctaatgacctcgcgtaaatcgaagagtttgaccagctatgatagctcaactcttgaattatcggtgttgtattatacccaattcgcgaaacactattatagcatatcggactacgagatgttaggaaacggatcttaacagcctttcctttgcccttcgcatctctgaggtcttgcaagagctctggtcgacggctcacaagacaatacccggcttgagtgagaatgatctcaagacagtctatagaatcattcaaatcgccgacttttgttcaatattttaggacatccatgagcatctcgtctatcagactggccatcttagagcgggcaaagcacaggttggagccagacgagtgaacaagtggaagaagcaaggttagacggcctctattagacgccgatcgcagatacacctctgtgtcaaacggcgcctgtttacgaagaggttatcgggcttcatgcggcgaggcttccgggtttttatatcgtcagggcacctaaacacagacgttggcaaccagctgagccgattaatgtgttcccggctgcacgttattagctcctactagtatttaatacggaccgatagaggcaactcactcaacgcgagagaagccatggaacattgctgcggaccccggcattaacggcgacggtattaagacgacccttgccagattcataagcaaccgcctcgagtgtgaaattcctgcgatctcaatcgttcacttcgcaatgataggttttgattctttgtccagttcgagtggcagtctttcctgctgtttctggagcatccgtgctcatgtttaatatgaatgatatccagctccggccgatgaattacatgaagcgagtacagaataaatttcaaattatgcctgatctctgttctgacggacttagtctctcgctagcgataacttcgaatacacataaaaacctgataaatcatcttcctccatcgaccttcaaacactcaaactcttattatacactgaaactaaacttctccctctatagccttagccaagcttctttccatatagcctttcgacgaatgctttggtatcctctacgggaggcttagagattggtaggtttttcttgataacagtaattgtcttctccttgaggttgatcgtagcaaatcaccgctaatatggggcaggtccagaaatatgcttcctggtcctttcatcgtgagccttcatgtcaacccgcgctggttgcttgttgacggtgttcttccgaccagtaataactctttccttgaagttgatcgaggcaccaccgcgagcctcgagacctcgtctatacggtgccggcccggagatatgtttcctagttctttcatcatgggccttcatatcaacccgcttgggttgcttgttgacggtgttctttgggccagtgataattctttccctgaagttgaccgaggcaccgccacgagcctcgagacctcgtctgtacggtgccggcccagaaatatgctttctagtcctttcatcgtgagccttcatatcaacccggttgggttacttgttgacagtgttcttccggccagtgataatgcgctccttgaagttgatagaagcgcctccgcgggggtcaagacctcgtctgtagggagcaggtccagagatatgctttctggtcctttcgtcgtgggccttcatatcaacccggttgggttgcttgttgacagtgttcttccgaccagtaataactctctccttgaagttgatagaggcacctccacggacttgaaggggaaggtcaaaatcatcaaagtcgagctcatccagttcgtcctcgaagtcacgctcgtcaagctcctcgtcgaagtcacgctcatccaactcttcatcgaagtcgcgctcatagagctcatcatcgaaatcacgtatggagacgtcctcagcatcagatctccccacaagagtgagatcgttggtagcttcgtcaattcccagagcgagtccccggctggcaaggccgagccagagaagtcctgcgacgctgagattcttgtaaccgaccatgttggcggttatggacaaggatatttaaagaaaaaaaaaggagttataaaaaattgaatgaataaagtctagaagaccagcgtctagaagttgatgttgttttctgagtgttgagggtatgtctttgttgatcgccagctgggaattacagtgaacatatcatcaacttaaataaccttcttttttacaggagaattaaagagtgttgaccttttctaacaatagccactagcgtaagcatagtgaaactgagatcccccaaatggatagatagtgtaggattcgccttctgtgcttcccttcacagcacagatttgctgtgaaggacacaatgtcccggtaattgactgatctgagcgcccgtgccaaccacgtcctgcttgttttagcttcttgaaagggcttagctgacagtctgtgccatctgaatgccgtctccacaccgaatgccgcgagatgccgatgttgagtcagggaacatcccccgatttttgctcttttgggaaagcttgttcaactgtattctacatggactccatgttcgacaagggaggtctgacccgtaaatctcacctcagcgattcttgcatcatcagcccttgaatgttatcgtcaaatggatggtgctctggtgtctgtgctatatttaccccatgaaatgtgaaaagggaggatgcgtcctcggtcggatatctattctctaaaacaaaggaactgtccaaacggaagccctgtatctcatcaatcacccattgatcgtcttcggccaaattagcggtagtgttggtgaaacgtttgtgacctaaaatatgatgccccggattcagggccgtaaccgaaattatcgccaccctgatcatatatcgtgatcttatgcatcccactaccctataggctatattgaggccaagcagatattcattcgattttaaaatgtggttgaagtctccagctaagtggagcgactgtaactcttctagaaaaggggagattcacatatttggtaggagttgtgagatatctaatatacctttagagctacccaaattacgagaagataccctcaatttcaaaagacttacacgtattaagcaatgtagtgctgattcgaacactgaatcaagaaattcgaggccttggagcttcacggcaagcatttagaaaatcagtaccacaccaagagacaccgctcacagtggccataaataactaacataaaacatgacctccatatgaagctagatggaggcagtacaaaatagatgtacctatattaaagcgaataatacacctcatttcaacacaagcttttcagtcacttgatgaaatcattcctcggacggcatctttcacacttacgagcatcttcgtacgaatataacacaacaagactagcctaaccaaaaccgtggttgtaaacgcaaactgcctaatggtatttggttgacattattggctatgagactcccagaatgatatggaaggaccctacagaggtcgacctggggctggtttccgtaaatggaaaccagcaagaggccacccaccagtcaagaaaaagaaactccccttgatcccggtagatgaatgcttactattccttccagtggcaggtaaatgccgatgacggccaggactttccccacaacacctaacgagtcagactacctaataatatcaagctctaatacatgagcagtctcgcccgcccgttgccctcaatggtacaagggttatgtgcgagccccttggcttgtacatcctacagtttcaatgtggggatctccccttttgtacaattcggatcttgtttcccaagatggtaaggaccagaaaggtatctaggacaatcatttttgtctagagttccgcgaggaaagctttagatctataaaacttcccgaacgctgtccaggtacaccttgaattcaatatttgagtgaaatgtctgcgactctcttgtccaacactttttacatttcatttcctttttcgtacgatagggcgtagcgcgccagctaagctcttcagatgcagaagctcaacaacgacctgggtacaccggctagagacaggctgaggttcaattgcttgtagcagaagggcactggaaggtctgcgcgtgcgttgctgatggcgccatagcctagatatcaggatgctttcaacagtgtagggtaagcattaagagcccctgatctacctattttaagatttgattcatgtcaactggtgggtcagaaaacttcgccacttcaattgaaacaattgtagaacacgcctcgctggcatcactttccaggctgaggacagcgcagtctcgagactacagtattccctcatgggcaagcgaaatcgcgcgcggggcctccaagatgaggctgctcaataccacaacactggaagtcaaggagtttaacaatccaatcccgtcgtatggtatcctcagccacacgtgggaggaggatgaggtcctgttccaagatgtgatgaacggggtctgtgagctgaggaaaggataccaaaagatcgtcggcttctgtcgcaaagcgaaagagtgcgatttggagtgggtgtgggttgacactctgtgcatcgacaaaagcagctctgctgaactgtcagaagccatcaattcgatgtacaagtggtacaaggcgtctaccgtttgcttcgcatatctgtcggatgtacgcatcagggacgacgcagaaagtggcagcgtctcatcttcgggggcggcaaataaaccattcaccctctccgaagcatcacggagtcgctggttcacaagagggtggacgttgcaggaattgattgctccaaaatatgttgaattctacacgcattcatgggaggagattggcacaaaatccagtatgatagggatgttggccaaacgaactggcattccagaggacgtgctgcggggaggaagtcccctcgtgcataatgtggccgagcgcatgtcctgggcgtctaaaagacagactacgagggaagaggatatggcatactgtctccttgggctgttcgggatcaacatgcctctattgtacggcgaaggagtcaaagccttttaccggctccaagagcagattttgcggcaacaagaggactacaccatgttcacgtggattgcaccgcccaagcttgatgttgagcctgattccatggttcgtggtgcttgggcctcagcgccgtcagagttccctctcatgaaaaggtcgactcatgtgaactggtcaagtcagcggactatatcagaaccaatcctctcaaaagccaatgacaaaattccggagacgcagagaaagctcgagatggtgtatcatgtcgactttaagagggtcgttcaattttcataccgtgatattcatgagagctttggacaccaagaaccacccgtggttactagcagaggacttcagatatggcttcccattcttgaagtcaaaaacacccatcctgattgggctcatctgacaccaatggagagacaattggcgtcaaatcggctcgcctggacttattgtaagctagacgaccgtctgctatgtctagctctagattcgtctgctgcagagcctcgatcccattatcgaatattccctgcttcactcgtcagtgtggatgcttctcttgagcattgcttcaaggtcttgcggctttacatgcatccgggtggcttggtccaattcggtcggcgccaagacccagagcaggctacgaatggcacttggataaatttcattccacgtaagaggagtctgacactgctacggtcgtatcctgtccgggctacccagaatctacatcgatttccccacgagggaaatttcattttgattatgagctgttgcctgaaggtagatgaaacaaacagctatcttattatcgcatgtggtagttttagagatcatcactggtgtacactggaagaagagcccgaacctagtgatgaggttggactaaccaagcagtatgctgatcttaaggggaagccaaaagctgactttaccttcttgcctgatagagtggccgtgacctgctcgaaggtgccacgtttggtgctcaccgtctctatgcggagagaaccaggatctaggtatcgtctggaaattgatgagtacagcacggacagtggaaaactatgggtggactcctatctgtcctagcctacatcagacacatctgggtgaatatagctcatctaaatgacgcacaaaacatttggtcaagtgaattgcgcgtaatacacttcggtatccacaaggaacctgttactgacatggcttttcactcgttacgatacagagcggatagatccgtattatttcggcaagcaagctccatcactaaggtcagacatgctaaaaggcatctctataaataaattcgatttagggacagattccgttcaaacctcgtatggtggtgttgcgatcatcggagctcctcaacatggatcactccaccctcgggattgagagagtaccgacctccgaacaacacgtcacaacgatcccaaagatccttcccagaagccagaggatatctgggcgcttttattttggggttcttatacgtgggagcagagaggaagccagaatttaggttacatccttaagtccggagttatcaccgggcataggtgttaagcccataacgcctgaactcaaagtgaattggtcaatggtagcttggaagcctccaatccttaaggcggagagaagtaactcttacgtttcatggcaatgcagagttggtgcaggtataaatacacaggagaccccgcatacgtccaaccttggacgtccttcctttctacatatggagtggtagcatacttatttggccttgttattatcgttctagtctcaagatggcagataaagacatcgtcttcatcacaggtgccaatactgggattgggttcgaggttatcaaggcgttgcttcaatctccaaagggatatcacatccttcttggaagtcggtcgttggaaaagggaaaagaggcgatttctcagctggctgaggttctggaagggtcttctaataccgttgaactggttgagattgatgtcacagttgatgaaacgatcaacaaagctgcggagttggtcgaggccaagtttggaagactcgacgcacttgtaaacaatgctggtgagccatgcttgcacctaactaccccattattgacaccgtcagggctgacatatgatgaaaggcgccgcttttgataagctcttcacaagcgatgcgactgacttccggactctgttcaacaagtcttatgacgtcaacgtttccggagctcaggtcacaaccgctgcttttgctcctcttcttatcaagtcaaagaatgccagactgctcttcctcacatcgggaacggccaacttaacgggccatgagcagggacttatacctgccagagctgctagtgtgccaaagggctggccgaaggaagggctcattggcggccaggcttacaaggcgtgcaaaactgcgctcaacatggtcatgatcacctggcactggttcctgaaggatgacggtgtcaaggtgtggtctatcagtcctggaatgcttgcaacgaacctcactggaaatccagaattgctaagaaaggccggggctggggaaccttcactcggaggtgacctcatcaaacgggtgttggaaggggagcgggatgccgatgtggctcgtgtagtgacccaaaatggggcagttcagccatggtgaaggtttacactggtcaatgtaccatcgattattctcacagactgttcatgctatctccaggctcttacttaagcggtgtagcaggatcagaccatctgaataccaacagtaatatattacccgagccctcactggccccgcaacaccatcagcctccagggccacatgacaagagtgtaacgtgtgacgctttgtaatgttaaatgatcgatgcctcaaccgttgaattgatttttatgtggatcgtcctgatgcgagaagacggaaccagaaaatgcattggcgtagatctatctatattacttggcacattatagttcgacataatactaccaccaagctgatggttgacacaccttctctaaaaaatagttgtcctcattatccagctaccagttttccggtttttgattcagtgattcatgccgtccgaataccagaccagccgagttttcccttcgtttgtctcgtgcttttttcataggttcacatttggcacaagagccccgcatatatgcaaaatcaggtggacaaattgctttttcgcagccaatatttcagtctctgctcgaccagctcatactgcgtaatctcggttatcttatgcccctgttacactgattgcaggtatgcagtacgcttacgttgcattcattatgcttgtgcaaacagggggatacgtatacgaaaatgcatatcccgagcggggttttgaaggatggcacgatcaagacgaaacacgtcggtgaagatattctgagccctcatatctttggacagcttgcgattctataatcccggatcttgtgtgcagcgatatggcatctcatcacacaccgatccagccgtattctggcccacccctgccaacacaaaaccacatccgactcatctcgctcaccgctggcattgacaattccatcgtgtgcgagttcaagacggtagagatagatgcagctccagcctatgaagcactgtcgtacacttggggagatccctccaaccgcaagacgatagccatcgcggctcccggagagtccgccggatcgaaggatgtctccatcacggcgaattgcttctccgcttttcgctgtctgctgaagtccaggtcgtcgcggttgctctgggtcgatgatctgtgcatcgaccagtcaaacactgtggaaagagaccaccaggtctccctcatgtctaagatctactccaaagcagctcaagtggtcatttacctcggtgaggcggcagacaacagcgacttggccgtcgaatttatcaaagaatgcgacaacccaagccccgaggctacatcccttagctatcccaagactaagaccctcgtcgagtctctttgcaacttcttccgccggccttggttcaccagagtgtgggtgatccaggaagcaatgctctctacgagtggcaccgtctattgcggagaccaaatactcccttggcctgcagtcaagcatttcaacgagtgggatcagagtaacaagtggctcaagactctaccttacgtcatgtccgtatcccagagctcgcttgagaagtcggatatcagggtttcgctgctcatcgctcttgtcgaaacgaggcattgcggggcaacagacccccgcgacaaaatctacagcctgctccccttgtttcactcggtcaaggaacagctcaaccttgctccgaggtatgcagactcggtcgccaaagtgtacaccgactgtgccactgctctgctatctcgacaaagctgcggcgttctcaatgctgtccagagtggctcgaaaatcgaagggctgccttcttgggtcccagattggagcatgccaccgaaacgcacagttcttggacctattgagtatgacccaaagtactacggatcagagccattttccttcaacaaggcagagaatccatcaagctcgccacgtcttgtagccaaacagtcacccaatgccaatacgggagccacaggcgctgtgcttcgtgtggatggagggctgtgcggcgaggtggcccagatgggttctgtctatctcgctggacagggtccgttcccttactttgaatggaaagctttgttgaatgacgaggccatcactcgaatcgatagaagatccgagcggtcctgggatggccacaaaaaggttctcgaatcggaattttacaatgttatagctgccaaccgcaaccgcaccggatacgaagaagccatacggcgattcgttcaaaaagaaaagaatctccagaacgaaggcatcggtgcttctccaagtcaggccgctaacggcggtgcgtcaaagccaagctgggaatctgcagttcgggagttaatggctgaagccggccgcagaggctctttggaggacggtctcctacccttccgggatattcccttccatgaagtcgcaacagaaatggttccaagctacaggtactatgtccaagccgtgctgcgtaattctcactctcgtcgcttcttcatcaccacaactggatacatgggcctcgccccagctgaggccgagttaggtgaccaagtttacatggttgttgggacagtgacgccgcttcttcttcgccctgtatcagctagtgttggtgatgacaagttaaagcagttctggctagtcggtgcgtcttttatggagtccaaggcgcggaaagacttggcagacaagcctggtacgctagagcatatcgagatagtttgaattcgatcgtggtcgagatatctattgaatttcgtgtaggctagcgttcgttgtgatccagcattcgaagggaaactatcacacgggtacgtgtcggtgaggtcttgggttattgtatggttcaagatgctcaagctcctggccgttgtttcttataaagtgtcaccaggcgttgtgatcgttactttggtaaaaatgccagttctagtagctaataatcttaatttatcaaagaatatgtacaaaaaacccgagatatctagacctcctgagcacgctcaagtgcactatatgaacggacttgccattctcatgtccagattgttattaaaacatcatatacacagtttattcaacccaaaacgccaatgaacatgtaggtggctaaggcagcgagagctccttggggtctacccagctcgtcccgctgagcctaacttccatcagcttcccgcccttctggaagtagcacttggttaaatcagatgccgcctggaggagcagcccgtcgaacgtgcgatccttttcccacgccggtgtggtaatgcaggaaatatcggtgccgttgtcagcgcctttgagttggtcgggtgcggaggtctgccacgttttatcgttgtcgacccaggcttgcttaatgtcaccactgtcgtcttgatacagcaagaaggtgctcactttggaagaagtgttgactttgttgggatcgcgggcgatggaaaaggctgcaaaagagtgcttcaaggggactttgggctttggataggctgcagcaagaattgtcagaaacaatgtacagaacaagtggaggcaagctactagaacttactggtggtccaaagatcaatgacatccccgagattctgcgatcgggtctcaggccaatggccagggtcgatcacagcctggatagtgccatcctcgttttgataaaagaccgcccaccagcccgtgccgctcacgtgagatgcgtttctagacacaggcacgatggaaagcttcgaccctacgatgggcgagtactggagagtatacggtgtccagggagtcgtggattgccaccagagtgccgagagactattgttggcgttctggtaaactgtgaatggaccccaggcggcgatatcgctctggggtgaaatagtgattccagtatcgttgacatcgagtttggtgaaacccttggactcggactgtccggctgttacgtagtttagacctttgagcttggcattcgtgtccaagtatagcaattggacttggatctacctcgtgttagcacatcagtccacctccaacgaacgtcaatggtacgcaagagatctggtgtagccattgcgcatttgtaaaacccacctgcgcgtcgacgtcactcgactggtcgatgcccgaaaacatggtcatcgccgtgacgttgtccaaagcattgtcggggacctgcaactcgggagttttccaatcaaacgtgccacccgtggtctccgaagctctgaagaatttaaccgcgttgtctgggtttttataggagaggtaaatctcgttgtcgttgccgttctgaaatgccgccacacctacagacgagcccgcgagaatcttggacggagcagaggtcgctgatgcagatggcgatgctgttgcctcttcgctactgccgccgccgctgttctttctcgatcctagaacaccacccagcaccgcagcgaggataactgcgaccgctacaatgcaaccgatgatgatgaagagctttttcctggaccggttgtttgactggttgtctttcggaggcaccggaggaccatcggagattgggattttgtcgtcgtcttcggtatcgagtttcatctggtggaagggcttgtcgggagttctcgtcgcttcggtggcggtggtgagggtcggggagaaagtcgtgtgggacggtgccacggaggaggctgtgaaaacctcctttccatcgtcgtagtagattttcccatcgttcaatacctcgggcgtcgacgggactggtaccggttcaaggccctcgtctcctgcaaagttgttgggccgcgccgcctgttgcgccgtccaggccatcgtgctcgttgttctggctcggggccaagtgctctcgccgcagttgtgatgagtggatgttgcagaaaagcatcatatcaacaggcgaaggttaggtatacaaaaccagaactggcaggggtcgcgtagccagtcacgaatagaggcatgcctgtgatgatcaatcagaatgtcacaccgcgcgcatgagtagacccatggccatagtggaggcattccaggatcttgggggcgaaggatggactaagcaaccacgcccacacgctatgtttgaggtcatatacgagcagtttgagggatggaatgctaaccctgtgaagagtcgggattcaaaatagttccacctactgatcttccagagaacgagaagacaaatctaccaattgcagtcaaaatcttcgcgttccggtggttgtgataatggccgcggcctcgcagcataattaccgaaacgccgaccctgacaactagcagggactccaagcttggcgttgtgggttatttcagcaaagtaggtccgcatgaacaacgattggtaattaagaaaccccgttaacgaaaatacgtcccagacttggactagagaggtaattaggtagaatttgtggagttgaaaactggcattttcttcaccagccgcaccctccagcgcatatctctcatcagcttacttgtacgtacatacaagaatatccggatttaaggtatcttgtcacgcagcagctgcgggcagacaggtcacgagtaatctagccgagaggtatcatccaaggccacatgccgtagtgccaccttgtttatgcaacggtctgaaaatgtcggtagatttctcgttcttgtttgataatcaacctgagagtttagataatcaaagtcaagacacaaatcttcagggaaaggtaataagcattcccaaaatagactcatgcacgataaagatatcgccacgcgaccaagcggaaaaaccggtttcaaggagcacaggtcaactatttttgtcctcaacaaggagtttcgagacagctttgcacctacccaacacagtatgatccactgcttccgttctggcgcagtcttttctattcttgatgccaatgccttccactagcagcaatgacgcgacaatacatacgtagccattcagcactgcaatgtggagggctgcgccagaaacaaaatttatagcaagaggcgtagctgagagggcatagatcattcttatcgccatatctacgcctttcgtgggtgtcgcgattgactgaagcgtccggctcaatatgtttctttggttgacgtcaagttggctgacaagtgcaccacaagaacgaggttttcattactggcaatcacaacaagtaatgcaagagaccattaagttcccatttgttgtctacccattgctcgcattcgagaccacgcatataggattttcactggtgagttatgagacgaggctgacacgcttgcatgggatatggcaaaatatgcttgaactgaagtattccgaaacatagctagactggagggtcaattctttcatggaaattttttatgaaactttctcgcaaaccaaaaacaaagactcacatgtcgcaaaaaggtgtatttgtatagattagctatgcagcatgatcctcatgtaagtgcatcgtatcagagaacttcgccacgagacacggcaacgatgcttggggcgatcgtaattcatgcctaaatcggccacaatccatacttcccttctccaagaagacaatatctcacacactcgtcaatgaactgggttctgggaagcggaaacctactgttgcctcagcaaatctcttcgagcaatgggtgacaaaatgcatcctatcttctatgggcacttgccttcgacaccaaggacccatgttcaagagaagcatcggctaaggacgctatgataaattgcgatgctcaaacgatcgaacgctgaatgaatatttattcgaaccacctgctttgccgggcgaggggctgaatgctttagttttcgccagccaaagaggcagcgttagctaagccattgttcatgttactacgtattcggtcgcactggcgtggtatcatttacattctattgaaagctgggcgcgtattaactctcaaggtatcaaaccaggatcaacggggctttgtggatagcttggaatcttcaaacctgatcccccccttacgcaggcaggtgagattgtggccaacgatacccgttagctaggagggctttgcatgagattgccaagatcaaataccggcagggaacgatgtttcattgcagcaaacccaaggttctcatagacctcgccccgattggcggaatctacggttcttgaactcctggccaacgtttgtcgtttcccggatgaaacactcttgataccactcttccaataaaaatcaatttatctcgactatatggggcaatgatgtacagccatcggcaccactctgtttcccgctgccaagcaaggttcatctcggatttgaaacaactcaatggggcatccataacaaggttacatgctttgcttatccactgcaaggtcataggcaatccgtccgctcggatgagaacactccgggcaccaaagcgcaagtttggagcttgtctccttattttttgcatgctttaaatttacacggcgtccgtctcaactttccccaggacacttctcgcgaaaaagcactgcgacgcacagctatccagacatcatgaaagcttccatctgcctgcccttcttcgccgcttctttagtcttcgggcacgctgtcgttgatgatccagctccccgcaaggtacgatccccctagtaactacaaaggcattgaactaacagctatgccggcagactggctcttcacaagaggctctttgtggatctgttctaacgaaagcttttgagagcggtttgtaacctacttcagtcgtccgtggcgggggccattttcttaccgaattatcttgaatgcagacattactggacctatcgaaaatgcagtaagcaaggcggtcgatccatatagctgcaacccatacctctgtcgtgggtatcagttcgaagataatacggacaacgtgcgcagtgtccaagccggcgatgttatccacttccatgtagacctagtcgctggacatcgtcctggatacgcggtatgtatctcggaagtagccaaatgatctgcttgaatattaaccatgacctggaaacagaacacctccattatcgataccgcgaccaatacagtggttggagagccgcttcggtcttgggacgaatggccgggccaaaacactggttccgatcgtgaagatagtatgttctgcttctggtttccgaaagctgaaggagctaactgataaaagtcaacttcaacgttacgattcctgctggtctagaagaaacatgcggcgaggctggtaaatgtgttattcagtggtattggtatgctaccaagaataagcaaacctatgaaagctgcctggacattcaggtttcttaagaggctcttcccgcacaggccataactccatggtgggttaagcatgttaagatggtatacatgtaatgaactgggatgtaggtgggatgtaggtaggagactgagactgtgctgcgagttcccaagtccctaactaattcctagcttggctgagtttcggccaaggctgtgagtttagagcaatagtgactcgaaaataaacaatctttagctcggcattctgtttttataggggtttgggttagatcggatagcactagccccttgatagtttgcggaagttaaagtggtcgtgattttaaggcgccatccaattctcacatcttgaagaggcatcatgtagatctttatacgttatccagcgactgtttttgatggaaaagaaagaggaaaagaaagtcgaggcttttttttggtaatatggtgacatggtgatatgataaagaagtggacgcacttagttaacaatgtaactgttccattgatagtctgagttttccgacataagatttaatatgtggcttgcttaatagatgaaccaaagatttgcaaactcgttgatttgaacatcgttgccgtcgttacctccatattaccaaaacatcctttactttgaggactttcatggcttgcacatgttggaactgacctacagggtagtcatattctcaggtccgggcccgtctctctaagacgaattgccacaagcgtcttttctgggatacgttccgactggttggtatactgaagagatggaggccttatgcgcacgggctgacttatcagccctttatctagatcttatgggccatgagcatagtttacagcttgcagggttgcccaggggagccggccgtttcagaggtcaaatgcgagaaatacgagaaatatcaaaccactcagccggatctcttgacttcgactgagtgaatacatgtatctagaattttggacaatacagcatcggtcatatcattgggtgcttgcacaatattgaggcatatattgctaccaaaatgctgaggaatatctttcaactcctctgcgccgcgctcgcagcagcccctgcagttgtgatggctgcagatggcgatacttcgttccctaaaatcggtgagcttgatgttgtcttcccgcgaaacgacacctacgctgtggtctcgccttttcctgtcatttttgggttccagcgcagcaacgcgctcctcagattcggcacttatctcgaatggaaagtcagctgccctctggtgatgtccggcatcggattcttccgtggtgacgagaccagcgggcctacgcaggttccatattactacgtgaatgagtcgcgcgccacgggaaaggacgtctacaaggaagatttccacctctggaggggcgagtcgaagcaatgtactgttagctggaaatttgaatttgggatagactgcaagagatacgacaacggcacgttcgagtctcgagtgggctactatccggagcagagtggcagtgtcaactttacccttgcgttcgatggcaagctccctcacgatgcgattgccggttatcaaggatgtcccgagcccgctctggctgtcgaggtccagaagaacctcactggatgcccagaaattgacggcgctgggcttgtcgacaccaagccttgcgaccttgacgtcaagtccgctgcgagtagcttggcggcggcggtggcgacaccaactatcaccctgaccgaggcacctggatctacaacaacttcacgatcgtcgaccacgggaacgtccccagggagtggaacgtcatcaacctcaccaacgggaaccgggaccagcagcaataacgataaccagggaagcagatatggcgcgtatggtagcactgttgctatcctatggtgcgtcttgattggagttttgtcgtttttagtctttatatgattgaaggttggggctcgtttgttacaaatggggtcatattatagttatatgtctgagagtgatcaagatactatgattgatatgtatgaaactagtctcatcgcaacctatctgccttattaacatgaccataccattgctgaagcacggtaaccattggggtgacatgcaagacttaccagagcaactccaggcaagaggccttggctttccaagcagaatcatatcccaccactgacctccaaaaccattggaacaaaatcggagggactcatgcccataattctccattaacagacccgtgtatgtagctttccgagattggtgtgtataattgacgctgaagtgcgacatgcatacgagagattggcctacttctgccaatccaaactcgcattggcgtgctgtggcctttccttgaccgccagataccatcggatgtgatattgacgcagctttttcgatagttacgtaaagccaaaaccctaactggctgacatttcgaggccgtgcatctcatttcccgagctgaatgcatgtctcagttcaggtcgcagcagaccatggtggagcctttccttcatgcatatgatgataatcaaagacattgatatccggactgtgaatgagtgtgggtgaataagtaggcctgtcccccactgagtcagattggagagcataccttcctttcaagtgtcttaattcatctccttgtacagatacgctgctcagtttacaatgaccctcgacgaaaagaatttttctcttgaagaggttttggccgttgctaagcgccatcctttctatgccccaagtgcccagtatcctccagacaaagatgccatcctggcgatcagggagcgggttgccacccaacctcgcacatctgatctatcgtctcagccattgctttggaagagcagtttgtaagtagggcatcagagctcccaataacttcattcggttcttttaaccaggatactaggtacaaggcaatacaaagactagttgatgacacgaacactcagaacacctttcgccgggggatttacgccagcgccacgggcggcggttcctcccgcgaaccactgttctttgcaactgacgtcgctgagaaccgtcaacatcgattcgctttcggtcgcttccttggaaccgtcgggctggtgacagacaaggactgggtggtcaccattcaccccgagggcgagctctgccggtagtttctcccttgtatgatacagtgtgctgtcggctaacaaatgtgccaaatcacagatccctagacctcaccatggaaattttggaaaatggcggtggcagtgtcctcgccgcaggcaattccatgctcccagaagcggtcgtcaatctcatcatcaagtaccacgccaacgtcctggccggagagtcgtcgcagatcgtcaacatggtccattacatctcttcaatgcccaacagcgaacgaggcaaattcaagctcgataaaatcatctacacatcggaaagcctgacgtctgggcagcgagctgaattacacaaagtcctcggcgccgatcttatgatttgctctcttttgggcagcgcggaggcaggcccgtatgcgttcagttgtcctagccttaccggcaaaaaccagtgcggcaaggggactgcggcatatgaggactttgtttatgacactcggctcaccataatggagatcttgcctgcgacagtcgacgagagtgacgagaatcaaaccccaaactctgttccggatggagagaagggtgttattgcccagacgtctctcgtccgcctgcgcaatccactagtgagatatatcaccggagatgtcgggtcgttgcacgatctgccagagcaagcccaaggctttatcccccagtcggcgtggccccatctgaaggtgcttcggctctatggtcgtgaccgtcggttcagctttgagtgggcaggcagttatcttgagttcagcgccctcaacgccctcatgaacaatgaaattcccgggatactccagtggcaggtcatacttgagaagatggaggagagcccacttgaaacaaggctcgagttccgtattatgctggctcgagatagctgtgattccgcagagaagatctccagcaggatcaagaagttttgctgtgtgattgcgtcttttgaacggaaattcaggattatattcgtgaacgacatggatgattttgtgcggagccctggtgctcgcaaagtgatcaagtttgtcgaccggcagggctgagttggatgatagctctgtatatgatatggtacgattcgagactaatattcgcctacttcatattctgaacatgatgtgacatcttgaggcactgttgatggatgccaatctcctagcacaatgtgaactatctaaatgcaagcgttgcactaagagaatagctctgttttcacaggggctgtatctaatctctcgtccgatcacgatatgattccttgccacttcgcctaggaatctcgtctttcctcaaagtatctatactatcaccggctcttcatggcttgcaccacaagcaagacgactcataaacaagttctgctcgcattcaatcacatacaattatacccattcgagaatacataatcccgtcttactcttatacaacaggccttcatatacttttccagagttatgatcctccagttctaattactaatacctctattaatagaggcaatatactaagtactctagtattagaagtactagtatacctaaataaggataaactaactattcctaatattttaataagtatctctatataagaaattataagtatccttttttactatctaataactctaattctaaagatattaggatctagatagctattataattattcttaagtaagtatattactattattactcctagtattatctaaattagaaaaaagtagttattatagttgttacaaaccactctccctgcgtcaccaaaccacaccttagtcatcgtcacaagtcacgtgaggtggactgatatgcttgatccccgacatatcagttgtatctacacaacgctaagggtgatatgttccatatccaacatatcacctctctatatatatacattcatttcagtagttagaacactctcttaggacagttatcaatacacttgtctacgcatctattgttactagcttcacaatactcgcacattgacagtgactcgcattgcacagcctacgacaacctgatcgcgccactcagaacaacaccctgattgattcaaccctgacctaccctagacccccgtccagtgtaagtcgcccaaccgtcacaatagtatatagtaaaggaattattaaatattatataagccctattaataatatataataagtaagataactctataaataccttatagattatatttttaattcttataataaactagttagagatatgcctaacctgacaagtaagccccaactcagtagacgggcacatcagatgtttatgatataagggcacttgctagaagaaggcactaaaaggaattttcctcttgacaatgaggctgtacaagcaggttctgggtagattcatccttacagaggctccattgggttatccaagtttctttgttgaccatggggtcgtttcagcaatctcggttaatcagtatgcgcaaaagtgacgacgttatgaacctcctggctgcaattgggaatatacgctgtctaactaagagtagagatcgtgtctactcttgaaactataaaaccttcagtttagcataaggcttactgggagccctgaacacccgttcaatagcatccatcgatttatattcctcaggtaattcgagaaattccaacctcagtatcaacagcgtgacaataaggcggaactccatctgggcaagcttgcgtcctaaaaagtagtaatcgtattgttaataatagaacaacggcacataaaaataaatccagaagtgggtgtatcaaagtcatagtcgagggaagaaaagaacaaaacaaaaaaaaaaagggtgcatgtaaacggtaggcaagattacgtaccggagcagccccgaatgccaccaccaaatgccagggctggcaatgcattgggattaaaggtctcgttgcctgttttcggatccaaggctaaccatcttcgaggctcaaaccgattcagatcccgccctgcgttactttgaagaagatcaccatgcttggcagtggcagttttgtagctagctgtgcgttttgaatcatccacaggtgcaggtgtggtatccatgtgaaagttgaggaagatctccgtgcctttgggaataggatagccgaggatctgggtatcgacagtggcttgacgaaagtttgccttagccactccagctaagcggaaaccctcctcacatacgccgtccaagtacggtatactagtagtaagaatctcctgtaccgaaggaagatgaggaccgggaaacgccgttctaagttgtaaccgaagctcattctggacgacaggatatgcctccataaatttcgtaaaccacgccagcacattggcagttgagtcatgaccctagaacgcatctggtcgtcaataaatacccttgagcaaaagttcacggcaaaagacttacgccaaccaacatgacaaacatctcatcaagcaactcttgatctttggtcagatcggccatgggcttctgtgctttcctagcctcaatcaccttgcgcctcaggacaaagtccatcatgcatgtgtcagactcatcggcctcgagggcatgaagctccaaccgctcaaagcgatcaatagctttcgtcatgacctgcgttagttcctttgtaacgacggcccggaattggcggtaccgcggtctgaatgtttccagcttggctgcccattttggcaggggagagtttgtgtttcgctcaactgcgtcgccaatatatcttacttcatctctcagaaacatgcccttgggtagcgggagtttgtccaactcctcctgtgacttgccctcgagttggtattgcagcttgttcatttcatacctgatcaatccaggttcctcgcccatggtagccacccatatggcgtccaaagttgcacgttgaaaatcaacatgaacattgaaggcttggtccttgtaaacagtcgcagctttgagtcgccaatattccagcagctcaatggtagccttgtagatgtttggcgccgcggccttgtgcaggaactcggcgctggtaacatcagcccagagacgtttctgggccttgagcttgggcgtggtaaactgagcgactgtggcttgcgggaacatgggttgaaagatggcagaaggcgtagccgctcggtcgaattcctttccccggcggaggagaatgtcttcgatttctcttgggtcttcgaggatgacgaaaggtctgcggatattgggaaagagcagttgggcaattggagtaccgagtttgcgggtggtaatggtgaacatggagtgcgagacttggttgcattccttcatgacagggaccaagtcaggaatatctccggcgatacgactggccgactgtttgttgtatgggatatatgggtagggcttgggtaggagccaccacctgatgatggcgatggatgcagcaagtgagagaccgaccacccagtaagccgccatgatgacggatgaaagcttgagaatctggacgcctgtatcgaatgggagatttgtgttttggaagagcagctgatggaattggcaggctggggcagctcgtgagtctggctggaatttgatggaggagggcgcgagaacggacaatgggagggagaagcactggcgggatgtaggaggcttagagggaattggattgcgtaggtggctgcgaggatattgaattgcattgttacagtcatactcctcatgcgctgctgacaattaagaggaccaacagttctgcaatggaaccttgtggcgcagtgacacgaacgtttgcgtgcgcgctccttggcaccaacgattcctcggcggcattcagtgtcgtaagccaaggttcggcccgctgcgggcccccttgtaacatacatgatttgatctatggatagaggatcaatttcctaatagtgagccttgacggccgcctagccgccagttgcctgctttttcgttgccttcgtgttgcctgcatggacctgcagcaatggattagtggggcgatggttgttggggtatcttatgtaggcagttggctatgtggcggtgttggtcttagttgttggtcttacactcgaggagaaagttccaaacgctgtgacggtaaagttcggttcccatgaatgcacagataaacttgaattcaacaaccagcaagttcggcgctgttgatggcccagtagtgtttttttacagtcgtaagaaggaaataaggaagcgctctctcactcaatataagagcctcaaagtataaatttctcagagtatatgttgatcgttgccaattttgtaatataagcttacccaaaaatctcctcactgtctctcgtatttactccatgtgccagttagtgcatattgcaaagccaagtcacccctcggttgcatctcgacatcaatgtcggcgtcaggcagcagaaacagcctggccacccccatcccaaacgaccgatcagttttgacacgcgaccaaccactatgcacaggtttaatgtcaaaactagccaccatcaacgcagcaaaacagaggatctctgttgttgcaaagtgcctcccagggcacagcaaggacccgccaccaaatgggcgaaatgccgcttggttgtagcgcttgaggctacctggtgcatcgctgccgacgaatcttcggtgatgaaattcaccagcgtcatctccccatatatcgttcttgaagtgctggacggcgttggggatgagaacaaggccaccttttttgacaagaaatcggctatccaggatgtggtcttctagaacttgcctgacgatgagatttccaattccgcgataacgcagaacctcttgaaaggtggattgtagagcagggcaagatgttttgatgattgaaaaatcaatagtgcacctatcctgatcaacccgcatcgcagcatcaacttcctttctgcattcgtcaaggacagagggatctgaaaatacgtgatgtatcatccagaaggcggctgagacggagttgttgaggattgcaatggttgacccaatctctcctcaggcaacatcatccatggtgaatcccgcttggagagagtgattgagacgtacgagaaccccttccgaggcagtgttgtgatgcccgcagcgaaagtactcggcaaatccctttgtgagatattcccgcgctttcagcgcttttctggccaagattgtcggcagaacatttgtggccatgaaaggaactcctggttcaagttcactgctttcattagcgtggatccgtggaaacaacggtcaaaggacgctttcaacctactaccaagcactttcaaactcgggacagcggaaaggatttccaggtccaaattcagcgtctgttgttgcgatggtgatttcatgttggatccacttgaaaagacgaaccctggtgacgccttgtgctcgagtatcatgaagagaggtttgtatagaacaagctgccctggaaatcattgcgtcaagactgggccctgggccaacagctgggcggaaagccttgtgaaatgtgacaaagtgtccttcatcactcgttggactatcgctcatggttcgttttgcatgctcgctcattcctagcaggtttgagcaggcttttgcctctataggttggaacgcaatcacctttgcctggcgttcgattgaagtaaccaatttagtttcgttgacgatatatagacgacagaaaggtaggcgtaaagtatagattggcagcctatactgttcacttaatatggagtattagtacttgttcacgaagtaatttatgatgacggacacccacaataaatggaggtaaagcctgaatctttttgatagaatggaagtaatgggagtaaagaatgggattctatccagcaaaacaggcggttctctggggtcttgggaccagtgcagcaaaccaaggagaagcgtgtacagggccgcagcccagagaacaacgattaagataatattattcatgtctgaaccgagaacagcacctatcgtctatacgagtcgatgagatgaatgaaaagaagaaaacaatattccaatgagttcaagggaagaatgctgccgaggtgggcatgtgcaagtattgatgaaagaacccggagccctataaagagtatatcttccaagtatatgagtcatttatttaaaataatgcggtatctccttgaggaaatccgagcaactaggctgctttgtagtttacaagccaacacaaggctgacgtatctcgcgacatgaacaaacatagtctacatggcgatacctctgcggcaatggatgagcgacgagtacagtcagacgcattgagctgccttcggccattggtcacattcatgtgggcgaagacaccaactgtccgtaaggatgcacttgggcttctgcagaaacagtggagggttgtataccttacttggcggccgcgccttggctgatttggttggtccacgtaagatgtgatattccttttcatacctcgcatggtccccattgcccactatctggtggaggccagattctttgttcctaaatccataggaattttaaaaagagacatatactagggcccagcagagttgctccagacgctaaccgccacacatacatacgcaatacccacaatgttcagcatctctatgcccctgagtgccatattttggcttattttgttcctcttcgtcgctttccgaggcaaaagttacgttcgagccgtcggcgtcgctctcaacgtcatgtactctccaattaccagtgaccccccgatactccttgaatttatttacgttgcgctttctcacaaacgctcgcagtttttccatcttcccactgaggcagcttcatcgtatttggggtttggaattgagatcaattgggaaatccacatgcaaaacatcaaacatcgcaaaggacgccatgtaacaagatgatgatagttgattacatgtcagagtaggatttgaggcgctgccaagtgttttgtcgcttgacgacgatccaatcgacgttacccaagactcagtggccccaaaagtatttaagatagtaataaacaggtagtcgcagctgcagccctacggcgatgatccgcctgtatatcatagaagccttgatgactggatctggtagtatggcccgtggccccatgccatcaatttacacttcggttgagtgacattgcggctgcaagattacgtgacccacgcgtgaatctggttaggtagcaaactagtagtaacattcagcccttttttccccccttggcacacatgcatatgtgggtgctgtatgactgaaggatttctttctttatacggtatcatggcacgtacagtggacttttgcctcttcgatccttctcacctttgcgctactccgagtcctgttacgaccaagtgagggtacaaaacaaaactaaacactttggacattccccatttcttcgcgcttcccagcaccccagcatcacaaggccttcgcacttctttctcatatctacgcctatcttgttcttcgccgttggcatctaatctgaagcttcaactgcgacaagggcgttgaaaatattgaccgaggcaaacaccatggagaacttacccgccggtattccgccagagggggtaatccccaatttcattgaccctccaacacaggcattgataccaaaggccttcatctatgccacatttcccctagtgctaccatttgtagcaatgcggttttacgccaggatcaagtatgcaagagttggtattgatgactgtaagcctttcttggtcccaaagatagcttctaaatggtgattctggtattgacagctttcttcagatttgtgcgcattggcagtagtaagttatgggcctgaaattctttcgacgggttactgaatgaacaatgcaggtcagtcaggttgcgcaactcgccctcaccttcaaaggttagcttccctccgtgcacttacgaaggtatgtagactaacaaggtcggcgaactctcagtgattgagcaggctgcaggacctcatatgtgggatattcctcttgtcaaaatcacctcgtcttatgcacaggtagcttctcccctcggaatatcttagttctcttctaatgcttagttagaacagtactgttttgacacacatgtacttcgtctcggccatgctaatcaaaagctccatcctatcctgatattcgcggatattccatccatctcccatggcaggttttttcatccacggcgggatggtggtgaatgttgccttctatgtttcaatcatcatagctttcatcgttacttgcgtcccgcgtgcagcagattacgctacgggaggatggctttcgcttgagttttctaaccgttgctatcagtacaattctcgtattggaggtacgtctggtgtgatgagcgccatacttgattcatatatcctggtgctacccttgggattcctgtggggactcaaaacaacgacgaaacggaagcttggtctctctgctgtattcatagcaggctcctcgtaagtggtacagcaaatattcccattgttctttcgctaaaaaaaaataaaaaaatttcagcgcgtgtatattttccatcgccagtgcgtatttccggctcacgatcaactccacaagcccccaagaccaagacttgagctggaaagccatgcctatatacgggacaaggtgagcgccctccgtacccactgctgaggttcaagagtacatgagatttctgatattttatagtgtcgctgagatcaatatgggcatcatatgcagttgcatgcctgtaatcattattctcttcaaagggtttaattcgtggtccacccagtttcttagccgaattcggtcctctatttctaatagcagaaaattttccgatcggagcaaagatagtgacatcgagatgcttcgatatgaaggcattgaagaaaacggtctccccgaggttccgagaggaaccatgactgggatgagaactttcatgtcaaacttcaacagaacaaggcctgccaaaatgcagaccgagcttctaacagtggccagtgcggatctcaactatcatgctcagttgcgtcaggaggtggaaaggaaagggggataagacgcccatgtcaatttgaaaattatagtataggcaacatgttacctcggctccatatcttggctcattctacaacagccaatattagtaggattgcgaaactacctaaaaaaaaatacatctgcattattcggagatgaatagtctttctttctttcgaacattagcatccctgtagctctaaaatggctcagccacttcgtaggaaccaccatattagtcaatataggccagcaaacttgcaaataatccatctgcataatcattcctactcactccatttgcaaattccaacctccaatttcaggtctttggtgttctgttggcactatgtgataattggcgctagaacatcaagggaggcgtatttaggcagctatctaggacaagagaaagagggaggagccttgggggtctgacgaggtcgacggcaatgcggtgggaggaacctttggtgcactagagacgcactatcacatacttggttggcaagttggtaatagtcctaggcataggctgacttacagcagtggagaacaccatatgttcctgtagatagggatattgcacacttgtgtaagttatcacattacgtcatacaatatgtaagttcgcatgtatcttaatgtcctgtaagaatgaggtcacaaaggatttttttgctgccacgtattctatgcgggtaatagggccgacccatttacgccgttggtagcaactgaagtaaaaacgaaggatcatcacggccacatggcatattaccaccctcacacgcaagcactgttggctcttcatagcctgttaatctctcaggataggtcggaacaacgggctgctgaaaaacaatattatgcaacttttgggtaatctccttggtctcttttcatttggattggggtccgatgtgccattgtgtccgttctgccaaggccagctcaggtcaacctcaaatccccactcaaaacattctggggggatacttaagattccttatatgtcgtgcagtcctctcggtagtgttgatcatcaaatatctcagctgatatcgagccattctcggcgtcttgggctgctcgttgcttcaattggagtttgatttcccgtatatttcccgttaccagcgcgaacgccaacctgcgcaatgcattcccctggagtagctcaacgtctagcacttggcttgatggatacttttcagagtatgaatgagttccaggtacttgtcttttgtggaactgtggtattgttagctgcctgggccgcctggtggtataccaagttcaaattcatgctgattcaacaccctagggagcccaatgagatgccctatcttatcccttgtgagtattggccatttgtccgatattatggacttcttcggtacaatgaagtgtacaaactaacgaaattgtcccagatgttggtttgtcacacccgtagctatcgggagtcttatgtttaaatgttaatcgatctaggaaacgccattccgtttttcaagaattctcaactattcctagccaaggcgcagtcagtccagagagaatacccttcgtggtggagtgtagctaatatgatacatagaaattcggttggtgtggataaatcaccgtttgcttttacaattttcggcaccaagttttacgtcatctcggatcccaaacatgccaaggaggtggacaagaacaatggcacgctttcttttgacgagtttatttttgactttgtcaagagcactggtgtgagcgatgagggtatgcaagcctgctatttcaagaagttgcccgagcatggggtcgacttccccaacccatcagaagacccgataggcgttctcgttcggcatatgcatgtccatcagcttcatcccggagacaatcaaaagaatgtagaaaagcgctttctgcattcctttgaccgcgacctgcaaatagatcgcataagaaactccaccgttatatcaaatgatgctgttgaaatatctttgtacaaatggtgtggcgacttctttacgagagcaggggagtatgcctattttggtgatacgctggctggtatcgacgacaagttctcggacatgttctatatattcgatgagctcagctggcagataacatacaagataccagggatatttgctggtgaaatgaaggctgcccatgcccatctttgtcaaagtttgaagttgtactttcaaacccgccagagcgagagaggcgagcaagcttggtttaccaacgctgctgagaaaggcctcagatcagtgggtgtcacggacgaggatattgctacgcttttcttgacaatttacttgacgtaagtcttttgcgaacttgactacgctattcaataacccaacttaactcttgcctgcagtatcaacaccaatacacgccgggatgcattttggatgctaactttcctactctacaaccctcttctaatagaagcagtactgggggagacaaaggccgctttcgatgctggcaagctcattgaccccgcatatctctcaaaccacgaactatgtcctcaactagagtcgatttggctcgagactctacgcgccacttccacgggggcatctgttcgctgtgtcaacaaggacacgatcattggtggaaggcttttgcggcaggggaacaaaatattgattccctctaggctgctacatttggatggggacgcgtggggtaaatccacgcgcgaattccgccccaagaggtttctgagcaagaagaatagtgctcgaggaggcagctggagaccatttgggggcggcagcacgctttgcacgggccgcttcgttgctgagcatatgattaaggcttgtgtcactatgatcttgcatcgttttcatttgcaaattgtcggcgatgccgcattaccaatgggtgacgagtgcacgcctggtctaggcatcatgggcatcacccaagatgaagactttaaggttcggatcacaaagagagcactctaaattctctacacttcagacttggaggtttcaggttttattctttatctctagatttgtccaaattttttgttgatttccttggcaaaacagccataagcttgggaaatagcctctaggagcattcaagggctatgtgtggcgcttgataggtaccgttcaagttcttttctgcattttacaaattttaatgtgatctgcataacattaaaaggcaattaataataacaagcaggactaatggtctgcaggcagtctgaagttccaatgcgtgtaagcctaccactgcagcttgacatccttcttgccaaccaacaacagttttcttaccaagcatgtgaataggcatcataatacacgcacatatctttacctgcagtaataaatcaatttccttttaaccgagcgtgacatgaaacgcattcatgcctgtgtctgcatgtggtatggatcccacaccatcgcatcacttcggccactcattgttccacacccctaccgccattgtgacgaagctgcttatctgttgggcagcacgggctttttgctttgatattcttgtattgcggttgattgacaacaaatatgggtcctacagcctactttttatctcggccagagcaatttcaatttttcgtaaaccacccgctcatactcctctcacccctttgtcaaaatgaggattcagcaagagactgccgtcggtggcgatcaggagagacagtgttcagatgaggatgatgacgtgaaacctcgcctcggtgtttgcttctcccagctcaactgttatgggtctctcacaatagattagtaccaggccacggtagcatcgtccattctagtagttcctatgctatgcttaaatctcttgaggtcgcgccctgtgcacaagatacacatccttaaggactttaagggcctcatttgccccggagaaatactgcttgttcttggtcgtctagaaagcggttgctctatattccttaaggcgttagcaggtgagacgaacggattagagattgacaccgagagcaatatttgctatcaaggtatgtatatttaattcatctgcattgttatagtacagagtatttagattaaaattgatttagttaatatttctttggtaggaattccattcaaggaaatgcacgaaagcttaagacactagcgaatttacctcgccaaactcgatgtccattttcccgaattaatattgggataaacccttttgtttgctgtgtcttgccggtaaagagtctctgtcgaacaagaggccaaaaagttcgctgagacattctgtcttacccaggcgtttggcatgagagttggtagtgatatgatttacagtattagcggaggggagaagcgcagaataagtattactaaggcctttattagtggtgcctaggcgtaatgttgggataatagtatctaagggctcgatagctttactgctctaagaaaaaagaataatctaataagagattctatctactcttatctagttaaatagataaggggttgattagtagttagatcagtaataaccagtaaataccggctgttatatgttttttatatttttattaacttattatttttttggttgatcatatgcctctttgatgccctctccacaaggctaacatggcctcacaattggtgaccaacagctagagggaaagacaaagaatgcagtggagctggagccaaagtacaggtctgtggccagtggctaaatagggatgtcccatttggcttcgagcctcgattaaaacaccagggtgcttgtgtcctgatagcaaccataacctcgaatacctccttggactggcggtgtaggggattgatcctccccggatcttgatgagttcaaaaacttaacctggccatttccgtgaaccctgtctcatagggcaaagcagtcttaaccaacgactcaaaatgcttgtgaaagtacgagactggtcatatttttcatcacccctggtgctgctgccttgtcatggcccactctaacgtagttgtttctatcagcactaaactgcagtgcctcgtttcaccgcgccgtgaattcagcgaaacaccaatgaacaaggttaagcatatatatatatatatcatcctcattacattttgcatttccattcacgttgaaaataaacctatgatatctctaaagtaactctccggactaccaaagttggttcctattgaaccatggctactcaaacctccgccctctctcagactctggagagcatcacgctcaccaagatccaggagctcgaaaagcagcgagacaagtacgagacgaaaaaagcagacattcttcatgaagcgggggaatacactgacctgagaactcgcatcgcctccctcattgtcggcgtaagggaaatctaccctgagtgtacttcggaccgggacgtcaagaatatccactattggttgaaccagtcaatgcacgacgttaacgtccctgatgagctcctgaacaattacgaggaggttcttaggtccaagctcgaagttcccacccgaaagtttggtctgggccacctgtacgcaagccttgtcaaagaatggatggccgtgtccgccagggaggcttccccaggtgcagaagaagagaccttcgaggtcatagatcgccagaagcagcgactccaggagctctgtgacaagtttgaaaaggtggttttcgagcctcttgaaacagatgaagcagagattgagcgttatctggtccagttgtttgctcgagtggatgaagccaaaggacaggaatctctcgagttcttgagagactcaattggaaactcttgctccattgtctttggggctcaagcaccattcgatacgtatgttttgaaatggtgtatcaagggcctgctggctgaacacttgatcagtgaggaaaagcagaatttgcttcgagggtttctggacaacgaaattgtgttatctgagatggttgatgtcttgaacacaaggttttcagatattgaaacttgggaatggcaggttggtgagaatggcagtaagtaccacagcccagccgcaagacttggaatcaacttatcaatccaatactgattactgcgccactagttcccgttcttcccaggcaacagctcaatggcaagtaccgaatttggattgatgaagacgttctgcaagccttactcgttcactacattggtacaaagttctgcgtgaatctgaaacaaacacttacccagttcatctccaacaagtctacttggaaatggcatattggaccatatccttacacttgggacaaaacccgccgtctctactatctcatggacgatgtttcgccgcatggatcaatcgacactatgagatattctcaatacatcgaagacttctttacttgtgccttgccaagctctgagcatactcaaagttttgggggctatcttgacgaagccccagatgagacggaggacgataagaagggcgggaagggcaacgtcaagcaacagttgctgcgaactctagccagcgaggcactcctacatcgccatttgaagggcgaagtagccatgatccagactgatttggagtggtatgctaccggcctctctcactccaccatcttctccgtcatgcgtttctttggctactccgacaaagtgatcaacttcttcaccaaggtcctccggccacctctgaatgttcagtcccctgagcatccttttggaaaaggccctcgtatccgacagcgcggagttcccatgtcccatgccattgagaagctgtttggtgaactgattttattcgtcatggattttgccgtgaaccaggaagatggattgctggtttatcgtctgcatgatgacatctggctgtgtggagaaccgacccattgtgccagaggatggcaggttatgggcaatttggcaaaggtctttggcctcagtttcaaccaacagaaaactgggtcggtttatttcactggaagtatgaaagaccctgccgttgagcaggtcttaccgacgggagaggttcgcgtcgggcatctaattcttgatcccgcaacagaacgatggaagattgattatgttcaggtatctgagcatgttgcgcagctcaagaagcaacttaatgcttgcaagagtgtaatgcaatgggttcaaacgtggaacagctgtatgggccgattcttcagccatacgtttggtgagcctgcattctgcttcggcgacggacatgttgagagcattctggacacgtacagggagatgcagaaggctctatttaatgaaggaaatgctacagacattggcgtcgttgaatatctcaagggcgttattcgagatcgctttggtgtcaatgatgtccctgacgccttcatttatctgccggaacagtttggaggactgggcctcaccaacccgtttgttaggctgcttgaaattcgcgagggtcttcaagagtcaccaccagaaaagatccttcagaagattttggacgaagagaagaaagaatatcttgagttcaagaagaacttcgaggaatatcgcaactttgaacgacgcgtccatcgttgccttctaaaagcaacgaacaaggaactcaaagagacgtcttttaataggctcacagctattgagcgtgaatacttcatgagcttcgaagaatattctcggttcagagaagtcttgagccagccactagctacagcttacgagaaactaacaggagttcctgacgtgataggaccaatctttgatgatgacgtacacaagatactccgctacggggccgataaaaagcttcttggtggcgattcaaagaaacgagagattggctgggcattgcagctgtacgcagatactcttcggcgcgactatggtggtatgagacttgtggacaagaagcatctccccctgggcgtcgcaacagttatgcgagggaaagcagtgaaatggactatgattctatgatcgcgaaccaaactggaatgtatttcctttgtgttggtttaccttgagtagttttcatgtaattcatttcatttggaaaatatgttgatgttccgccatgtcaatgtgtctggcctagtacgaagttaatactaaccggtcggctggtcattcgcaaatttgaatgtcttttctttccagcttagtaccttttaacgtaatcatgtcattccactctggctctgcttcgtgattttcaagatcctcttcgtcttcttcatagacatactcaattctactacgaggcgggcatgcccgtttgggtgtggtaaagcaaagcattgggatcaacagggatattcaatataatactaagcaagcaatggtggagagtgaagttgaatcgcatgcattctgtctgtgaggagtatcaataatagtaaattggcaccccaaagataatccaccttgcaagcaagataatatgaacgacagccaattccaaacactgcgactcgatatccagactaagagtcttatccggagcagtatccgaccttcttcggctcgcagcctccggcacagccatcgtagaaaacgcaggggtgggcagcatctgtgcagacgttcttgagagtggcagtgtctccgtagttcaggttgatgccagcgacttcaccaccgttgtaggcagttacaccctcaatgtatacgttgcgcttgcactggctgctgcagttgccgcatgaccggtagacctttccgtaatcattggcgtagaagttgatgatgttcacggtgccgcagccgttgtgttgaacgatcttgtcagaggccttgtaagcaccacctccgatgatccaggagtgctctccggccttgtctcctttctgtttttaaaacaaacagcatcagtaaaaagtcggggttacgagttttgaaaagagttggtaaactaacgacggtgatggcgtcctcgcagacgtcctcaaaccaaacgaatctcagggtgcagggaccaaggcagtgcacgccctccttctgattctttccaatgatgacgttctgaagagtagctccagactcaagaaggaaaacagcgtcagcgtcgcctattgttcaaatatcagcatctccgttgtctatctcggcgatccccagggtttactaacctccttcaccactgttgcaagcgccggagccacggtcatacttgacccatccggcatcgaaagtttgtccagctgcgatcctgataggcgcagaaatggactttgagctcgttggagtgggaagaccaccttcccagcccaagcaggccaggactgatgggatcagaccaatggcgaggacgccgacctttgagagtgaaagcatttttaagcaccttatgctggtgattcggtactaaaggcgaggctttattcttatgtagttcaagaaagaaagtatttgttcaagttaaagattacaagcagccactcttatattcgtgccaagactctctcgacttgcactacatattagttgcccgtcaactcctcccctattttaagcacaacagtaagcttaagcatttgattgatggaaataccggcaatggtggcaattctatatcatgggcaactaagttaggctcatgcgataaaagaagcatcaaaacaaacataatatgtccgtggctgtttagggagatagtgggagaacccatgagaagtctggtgattctattggagcgcatttaagtgactgcccgggtcatcccccacctacggacgaaaggtcgtagtgctggaatgctgctccctttcacatgacttatgcccagttagtccaaagcaagtcgaatgaatgtcagctaggatcaggcaatgagaccttgtagatggtggtggtgtcacggttgtcaggcaccaaaacggaagttcggtggcatctgcctccgaagtatgttttgggattcaggaagccactgagaaaggcagctgaactgtctagggctggcctgggaaataaaatagctgtattggcctttccttgagatatgcaaagaaaataaccttatgaagaagatctgatctgcatgtttaaaacgggggagccgtagacattcagcggcttgtgggtgaggagtatgtcacaagtggtcatgatatgcacatgccccaagcaagattatcttcggtaagttcggaacaccgacctgtggccgaccagggcacgtatttcagagccctatgagggataattcactcccttcaatcgtaggcgacgttgcatctcccggcaagagtttccccgcatgatccatgattggcggatcctgtcagtattcagtctcaagattcgataaccgagacccgaatatcttggtactggtggttggaaatgtttcgggaaacttggtgtaggatcatatctttcaatgccaagcactcagcagcgacacgatttattttacaagattaaattgttgtattggaccgtttataaaaggagacccttgcttcttgtttcattgtggtgcaggtttcgcattggcgggatcattaacaccgcagtgtgtgctgtgagatgaagggtcgggacttgacactcgttaagtttttccatattgaagtaaagtatttcggtgttgctgtttgggttgaccgcaatttttcttttccttccctgacacaagtgtctggtaaatggcgtgcattgtagtttcaagtacaccaatttctaagatgccatgctgcgcctatatgatgcagctcactgtgttgtggaagtgatgagacactgtgatcgttactttgggtactttagcgaggacgtatgtattcgtttgagaatgttgtcatctttcaatcaatattgcaaggctaagagttctcccgcgtttctaaatacagattcgcatcctcgaactggtcacacgaagacttcaagccctacttaaagcagcttacctcttcttacaatcatcccatcacgggaagaataccatctacagttcgcaaggataattgggcttggctcccgaatttgacagacaattatatgcccgattcggtattggggaaaatagtgccatgaaacccacctgaattgcagcatctgttgtgatgttgcttgcagcccatcaagattgggattgatagatacggaagagaagctcactgggacgagaatcagcgacagtaaggccttatgctagccctgcataggaagcatgaagccagtttggaggtagtacacctaaatgtttctcccccttctcccccgatacgagcaaataccacgctgtttatgtatagatgcgagattggcgggaataactggcgagttgctcccaatcgttaggttggaaaagggcactgctaccacggtagaggtcaagatatcatgggacgtgggcggcggatatcacttgtagatcctattactaaatacgtgctcaagtactttctagttacataataatgacacggtgccgtgaaagtattgtgccccgcccgccaatctcgctcagcccgtgattttctccatctgcaaattaccaaccagggagctctcaacttcagatccaatgtgacagcacctacatcaatcgagatcaccaccgattcctcatcttgcgacatacttagccggcggcattttgtcggatgtctaggaagggaagtctggggccatcgcgatgcgctgctcctgagagaccatttgtagacgtctcagctgctacaagatctcaatcggcagatcttgagacaaatgacgatgagaccgatcaagcagcccaggtgaagcctcacaagcgcagaaggattactcgcgcatgtgatgactgccgacgcaagaagatcaaatgcgatggcaaacagccatgttcaagctgcgctgaattcaacgcaggtaaatacaagtaaatatccgacaggaggcctcctattaaccactccagtactttaggatgtacataccagatcccacccaagcgcataaagacgtctttacgccgcccacagccggacacggatgatataaaggccaggctggagctcgccgagtcactcatccgcaagtttctgccgcagattgacttgcaaaccctgggatcgacagctggcaagttattgcaaggccatgatacacgcggcgctgtgtccggctctggtcaggcttcagctgccgagccacccgctgagagtgacaaatacatccctctgatccagaacgaagatcagttgcgtttcaccgataatggtgaactcgactttcatggcacttcatccagcgctaccttcttaagccgtatcactcagaatctcccggagctcctgcgatacgattctaggatcccatttctgccgcagttcccacggcctgatagccctttgaccggcgtatcttcgtcttttgctgaccattctaaatacgattactcgaaactacctccccgtcacctggcacgcatgctatgcgactactctttcaaccatgcttcatgcctcctcaggatagtccatgttccttctttttgcaagagcttcgacacattgtatgactcagggaaaacgcagtatagtccagaggaaggaagatttcttggactgctttactcgatattggccttgggatcaatgtacgatgtggatgagaatgatccttccaacccagatcactataatgaagccaccacccgggggtaggtattaggagtcacgttacctatttctagttgctaatctaataggcaggtacaagtattacttgggtgccaggttcttcctccctgacctcactgagtgcccagatatgacaagcctgcaggccttgctcttcatcatccagtttttgcaagctatcggaaacttgaactgttgttataatttaattggagttgccctacgaacagcgttgagaataggcttgcatcgcaatcttcctaatctatgtatcacccccatcgagagtgagacgagaaaacgagtgttccacaccatccgtcagttagacatctacctctctgctactttgggtctaccaattcttttgcaggcccaagatatagaccagcctctgcccactgccattgatgacgaggatatgatacagaatacactgcactccgcaccactcaagaaaccctccatcatccaggcattcaacgctcatggaaagctcatggagattcttgccatagtggtcgaacgcgtgtatccgcctacggccacgagcagaacagcaaccaacgcaacatacttgatcgactgtggtcagattagagaagtagaacagaagctccatgactggtaccacgaccttcccgtcatctggagacctgggcaagataacgacgtccagcttataaggtacactactctcttctaacacggaacccactccaagcgcagactttgctgatacgattgccaacacagggttcagattttacttcgttttgcgtttgcccacgttcaaatgatgctttaccggccatttctacagttcttcaaccaacaaaaacaccttgggaaccccccagaccagcgccaccaggtctttgcaaccaccggcatcaccgtttgccgcaatattatcagcatcggacacgagattaggaagcaggctgctctcttgggaccctattggtttattctctacacccagtttctagcggttctatgcctagtttcttatgtatccaataaccccaggaagccggagtcgtctgaaatccttgccgatgctgtcgcgggcagggaattgatctctggcctatcattgcgaagtcttgcagccgatcggctttctgttgctctcaatgtaggcaagctcccctcgtaacagaacgggcattgactaattataccaggcggtttttgaacagctacctagccggttgggttccacgccccccacgactaagaacatcacacggcgatcaccgcatggccccgtggacgccttcaggcccggcccttccttgtcagatcttagcaacgattggcaactctctagcgcctcagctcaaacactggctgctctacaggaagacattgccaccaaccacaacgagccgacgaaacaggcctcttctagtgaggcaactccaccgagcctgatacctacagatcgactcttgttttcctttgatgaccccgttgcgtatccttcaacagcttggtcagaatcactcgatccaactgccagtctaagcgacgaaacaatgcacctcgtcattccggatttcttcggagatttgactgagcacgatactgatccacccggggcggctcaatcaggggacaaccgcgcggcgtctcatccggcatctgcgttgttgtccatgggtagtggagggttgctgggtgattacatggcaagtcttttctgatatcgtaggagccgtgtcggggagagagatatagttgacggatgtagctttgatcatgttttacaggatgagagttagcggccctggtgaccattttgaattgttagtgggagtgaacccagtccctaaggcttgggtaggaggaccatccaagaacagcacgaattcctccgccaaatcgtgcggccttacgttcacaactaaatataccaccttgtcgagagctacaatgatcttgcttgccaacaagtgacaataaattcttctattcatcatggcagctatgatctgcatttaccgtttatatccctccatagtctagtttgttacggttccttattccagtcacggaacagtggacggttgccagcgaactccggcccattcaaggctccagtaccaatcttgaactccttcaagagaataaaaaccaaacaacacgctcgatagcgatcgaaaaatagggtcgccctgcccctgagtacgcaaaagagccctcaccaagccacccgagcgataggacctttcggaaactgtctcaccaataacttcctgatctcgtccataagtaaaatgcccagggctagagggatcggaatcacccagaactcaatgggaacacttgcggtgaggaacaatttctgcaagcccggaacctcggtcacaaagactgcgatggaaaagctaatcagcatgctcagaagcagccatggattccgtctcttttccgtgatagggtccgcctgcaatatgctcaatctgcggttgcgcacggcgagaatatttccccattgcagaataaccagcgttacgaaatacacgcactggccagtagagttgaaatttgcgagctcatccgccgagtacccgtggaaaccatctgtgtagccctcgaaaagaaagaataggtcctttatcgggatgcgagcttccttccagtagtataggaagtacatagcatgcgcgacgcaagtttccatggttcctgtgaagaggtatgcttggccatagatacgagcgttgatcagatggtctttcttatggttgcgcgggggtatagacagcagatcaaactctgccttctccatgatgagtgataatgagaggaagagatccgtaaagacacagatgatgatcatcaaaaaggatgatagaggaagtgggacgccgaaaaacacattgacgagaacaggccaaatctctgaccaggatccagcaggtagaaggtaggcgataaccttttgcaagttctggaaaacaagacgcccaagacggacagcatcgataatggagtcaaacttgttcaacaggacaaggtcagctgcgtcaatagccacatcactgccggttaccacggctacaccaacgtctgcagctctgagggctggggcatcgttcacgccgtcgccggtaacagctactacattatcccgctgcttgaaccttatatgtgttagtaactcatgcttcgtcgtgtaacggtccgtacgacttactcattgacaatacgaagcttctgctctggtgttgttcttgcaaatacaatctcctcgtattcgcaaacgaggttccagtcctcgtcggtcagtccaagaacttcctgtccctcgacaatcaatgcccgaccttcgccttcatgtcggctattcctcagtatgtccacggtaagctgtagatttttctgcatctcaccgacggtatcaggggggtgactttgggtgaaaatgccaatatttctggctattgctgccgcggtcagactgtaatccccagttaccattaagaaccgaatgccagctcgacgagcctcgcgaacggtggtagttgcctcggggcgtggcggatcgatgataccgagaaccccaaccaccgtcaaattttgaagggcagtgttgtgaatctcatcgctaaaggcattcgtgcccagggtatttgttggggttattgtcttttcacaaagcatgatgacacgctgagcatcgctagaaaggcgatcctgggttgccttcaatatagcgcgagtcttgtcgtcaagaggcagcgggcattcatttgttctggaccagtaatgggtacaagcgccagagagaatgtcgggagcacccttgataaacactctgtaggatttcttctccacggatgaggtatcggcgaacatagtcaacatccacttgtttttggagttgaatgggatggtgtgggtacgaggatttgagcgcttgagttcttcgtataggtctgcctttgcagcaaatcgtagaacggctgcatcagtggcgttgcctttgactttgcgttcctcaatggggaggggatccgacgcagtctcaaagtatgcgtcgttgcataaagtggacgcttcgtgcagcttcgttaaggcgttttcagggctgccacttgtgatggccttgtgaacctcctccggagatgacatctcatcagcaaatgacacggaagacacggacatgaggttctgcgtcagcgttcctgtcttgtctgagcaaagaacattgacacaacctaaagtctcgacggtggaaaggcccttggggaggatatcaactgctttcatccgtcgagcaaccatcatcagcgtaagcgatacgccaataggcatgccctcgggaatgaaagcgacaacacaccccatgacgttgttcagcatggcgacaacgttcatgtaaccactgtggtcaacccgcaaccagccaacccaaactaggacgatcaacaacgcgagaagaatagtcatgataacaatgatcctaacgaagcgccaaatctccctctgaatgagggtgggctcttctttgatgtcgcccatggcttgagcgatacgacccatcacggagcgagatccagtgaggacaacaacgcccagcccgttcccgttgacgaccaagctgcccatcaaagcgatgttgcggctttccaagaagttgggatccgtaacgtcaatggctccctcgatctcatcggattcgccagtaagcatagatctatcaaatcgaatatccccagaatgctggatgattcgcatgtcggccggcaccttgctgcccatggcgagctgaacgatgtcgccagccaccagctcggaggccggaaggacttgagtctggccgtctcgaagcacgtgagtctcagaagggagaaggccggtgatggacttcattgtgcgggatgttgaccagtcggagaaggcactgaacccggcttgaagggcaatcacaatcaggatcagaattgccaatgccaggttggtcggggaaggaggatcgctcaggggccgccaacaaatgaagaagacaataacaccgacccagagaacggagcagaatccaccaaagatgtatccaagcagcttcctcatgtagtttgtctttggctgggggagaacgttgcggccatcgcgcgtcaggcggcgcccggcagcatcagcggacaggccagcttcgggggagacattgagctgttggcagatctgctccgatgccagctcatggtagtgaaggccggaaaagtaatcggtgttgtctttttttgctactttgagatcgtcggaagagtccggttcccggtgcttagactcggagacgtggatagagagggtacgatgctctatctgatatccagagtatggattattcgaggcccggctgagggacctacgacggctggaattgcgactcaaagatctggggcgcccacgaccacggttttcctgggttgcagggtggtcagtatcgtgaaagctgatatgcatgcctttttcagcctcgggttctttggcattcatctttgtggtctggacgatggaagtagaaagagagaagcaagcagacagatgagtgagagcatgacacgtaatattagcaacgtttggttttatacattactgaaggccggccccccatctacaatctgctcatcaagcagatgagacaattatttttcccgctagcagataataatcgacacatgcatcccagctgagtagattcgccaataacctctcggcttttcctgccggaagttacgtaggataatgaaaagaaccccatcccatccgatgggaggccgctcggaaagatatcaagaagagtttggtttggtgtacctctctcacatcttattagtctctggtagccaggctttccgtgtagccgactagcaagaacatgattggctcagtcccaagctgacccggtatgagaagctgcactctcttccgcatagccggctgtagcgcagctgattggccagccaccgctctccgacatcatgcctaggctcaattaaattgtcgaaaccacgtgctgtgagcctctgcaggttcaggagcagcagttgctgtggaagatttggacaaatagagtcacagcataattgctatcgcattgttataactctataggaacatagagcgaggcttgtagtgatcaaacaatgatagcacccacaatggcaaattatgacacaggatgagatgcttctaagaggagttctaggaacttgtacccaatacattcatgttccaacccaggtgagaaattttcaagccttgcaacttttcagtctaccagcaccgacttccatatgatcaattgtccaggaatatccaatttcttcgacagttgtcttgcagaagccttaacgagcggggagatggctcgagcggtcaataacgcttattcttcatctcatatcgtgtgccaaaaagtacaaattgcggttctttaattcaatctagacccttcttcacaaggcagggacctccagtcagcgcaataacttaaccatcagagctctctctcaacatggaacgcatgtacttcgcagatgtgtttatcctttagtcaggctcgaatgtcttaaagttttcaacccccaaggtctaatatgcatacccatccagatagaaatctaatacacaccaattttaggtttattacgacctttccattaagcggtatccagggcttactaatggtacgggatcagcttcatatgaagagccaacacttggtttgtgagtcaccatcttgctccgcctcactctcgactcactgctttggcatccctaaggagtacggtacacatctcacagcttctcccattccaacacattgatcgtccaagtgctaactaggagaagttgggtagagcatattttgtcttctagagcccggtctattacagacaacatggccactgggaactcttcgaatgacgacccgcggaaggatcgctttcaatacaatgacatcggccctttcaagagcatcttacatacattggtcttgagtggacctggcaataaaaaggtcaaatttgatatgcgcgattgcgatataatggttgctgtcgcgcttgatgagtctactgtccgtctgctacacttacgaaatgtacgcgaggacacagtaaccgaggccaagaccgctattaagcagcttcttgatgagctgaaagcacgggatgataacacctgtagtccgcttactagaagtgggtgtatagatcgagagcacgtggatgatgaggttcatgaggatgttcgccagtttctttatacccaagctgaggagcgcggccccgacttcgactgggatgaatccgggtactcgcgctgggcgctgcggagttacggtgatcaagcatactttacttgtcgctggcgtaaagcaggccattaggaaactggtggtggcacacgtagaccttagtttgacgagggagagaagcttctcaaagagagtagttaagtctgggggtttgcatgcagatgaagattctaggctcgaggtctattcagtgctactgttcatcactctacataagttgcaggggtttgcattcggatccagaagtataactaatagtaccccgccatatcaaccgtcgggtaacgtcgaccgtcggttattcgctagccaaatcacacatcaaggtccctaattcccgaacacaagtccagccagtgttacaggctaaatacttgtatggtatggggtagtataatccggcagctcatcaatcccaggtgacctcacagggtttcattcacttgcctgagggaacccctgaggctgctttttaagatcccgttcgtttatgtgagctaatttcagttagtgggaacctaatcttggaggatcaaaacccaattgatgggaaatctaggatgggtaaaggcaatgatggttccaagaagccgggagtttgtggggtagccaaggctcctgaggataagcaaaaggctcatatcaaattctcaaggttataaagtgtcggatcatgtgagttgacacgaatgatgctctcaacattaatatttgtcccactgtgactcctatctttctcctgcagataatgcgtctcaactttctacccgtgacagctctggtccttgctgctaaggctgttgctcaggacaacaaggcccgtctctggtacacagctccggctgaactttggaccgatgctcttcctgttggcaatgggcgtatcggcgccatgatctttggtaatccagtcaacgaacgaatgcagatcaatgaagagtcggtatactctggtgggttcagatccagagtgaaccagaactcactcgaaacgctgcctgaagttcgagagctacttgcaagcggccgcgtgtcggaagccgagaaactcgcaaaggttggcttaaccgctacgcctcagtctatccgccactacgagacgctgggcgagatggccctcgagtttgatggaacctccaagtatgacaagaacacctaccagcggtggttgaatttggagacggcaattgccggggtagatttctcggtgggcagcaccaagtttcatcgggaaatgttctcttcataccctgacaacgttctggtccaccacctcactgccgaagggggcgacagcaagttatccttcaacatacgtgtgcatcgcccgtacggtggaggaaacagtgcctcggatatggactataataagaatggcgacaccacctacatggttggtggaacacagagcctggaccctatcaagtttgcaactgccctcaccataaagaccgatggaaaccttcgggcgattggagagtttcttctggttgacaatgctactgttgcgacagcgtttttcacagctgctacatcctaccgccatgacgatcctcttgctgctgttgatgagacactaagcaaagcggtgaatttgggctacgacgagctgcgaaagagacacctcgaagactatcagccgctgtttgacgcctgccgtctggagcttggcagcgcggatagtacggggtctgacttacctaccaacaagcgtgttaatgcgacccaggcgggaggtaatgatccaggattggtcgccctccagttcgagtatggaaggtacatgctgatcgcctcgtctcgtgagggaacactccctgccaacttgcagggaatctggtgcgcggagttcgaatcggcttggggttctaagtatactgtcaacatcaagtgagtacactgcatgttgcgataggtgtctggatgtactgaccacatcagccttcaaatgaattactggccagctgaagtcacgaacctggctggactgcacagccagctctttgatttgctggaccttatgcataaaacaggacaggatgttgctaaaaatatgtacggtgcatccgggtggatgagccatcataatactgacctctggggtgatacggcccctgaagatcgctacctaccagccacctactggacactctcttcagcttggcttaccactcatatcttggagcactactggtactcgggagacaaggcgttccttttatcaaagatagaaatcctatcggatgcgatccgtttctatcttgatacgctgcaagagtacgaagtcaacggctccaagtatctcgtgaccagtccatctgtctcccctgagaatacttacaagttacctgacggatcttcgacttcgatggcaattggacctgcctgtgatttccagattctcagagaattgttcaacggcttcatcgatgccgttgctactctcgacagttcaccagttgaggttgagtttattgagaagatcaaggacactctcgctcaattacctccgcaccagatctcgacaagatacccaggcgtcttgcaggaatggattgaagattaccaagaagctgcccccggacatcgccatgtctcccacctgttcgctctgcatccagggactcagatcccgccaccagacgcgcccggccacaacgaaaccatttggaacgctgcaaggagtacgctggattaccgcttgaagaatggcggcgcgggcacgggctggtcacgcgcctggaccataaactggttcgctcgactgctcgatgccaaagcgctgaacgaccacattttccaattcttcaacgtcagcgtgtatccgaacctgtttgacgcccaccctccttttcaagcggatggaaactggggcttcaccagtggcgttgccgaggcgctgatccagtcacacatgcggtcggaagacggcgttagggaggtttggctacttcccacactgccgagccaatggtcctcaggaaatgtcaccggtcttgtggcaagaggaggattcgtattcgacattacgtggaaagatggaaagttggcaaacttcaagatgaaaagccgtgtaggtggaaaggtggatgtcaggtatggtatcggcagcaatttgagtggcaagatcgagaatacgagcggcggcggcggcggcggcaattttaggctccaggaaaccgacgtggaaaacaaagttgccatcgagactgaaaaggacaatgagtacgagttcaaggttacatgggaataagcccatgccgccacctggccgaggttgtatgcagacctaacatgtctcattgagtcgctccgtacgcaattgtttattctcctacctttcaggcctcttttgtatattggcagtttctccaggtagcgccgagtcatgtaactctgccggtatagcataacctccatacgcttgattctgttgtagtgcgtcttttgcccgacaaacttcattggcacattagctagtactgggcttgaggctgcccagactgtgctatgggtgcctcaaccatcttggaggcctgaatttaggatagcccttgttcacggccaaaagaaatcaaaactcaaccccctccccccatctgagtaagaatgatctgtctaagaaatcagtaggtgtcctcccccgatagagacaagcaaaataaaagatctagacgtgagcaaacagcaaaacagaaggtatatgtccaagatcagtccactttaggcccttgatcggaagagaatagccaaacaagaaaagaaaaggaacatagcagctaaatcaatgcacggaaagaacaaaaatgcgtaatctgggaatcgaacccagggctccccgacgctgctcggatggcaacggagaattttaccactaaaccaattacgctggtcgatgacccatctcgcgatgtttcagctcttggatgaattcggatctcggatgctacagggctcagctctccctgctgtgcttcacctactcgtgggcactggaaagagtatggccgagtgtacagggtgagatagacacgagttctaagtcatcaccatcagaaacgttaacattcatcgggcaaggagttcctcaactcgggataaagcaggaaagaagcagaatggaataatcgagagtgtcatagaagatttgtaagcttatataataaacccttgcttagcaagctcttgataacacaatgataggccttgtatgtatcaagtagttatacctattatttgattatgtggccgagcttcgccaaagcaataaagcatgcaatttcatgtatgcttttcggtgcttccttgcattcagtggcacatcgaggaatgagtcgaggaagaaatcagtaatgaaagaacgaagtccgcgaaattttgatgaaattgagatcgtgcttctcataatcaagctgacatgtacgatcgaagaaccttctggtggtaagaaaacattttatcaacgtcttatcttgtctgagtgcactagatcccatccatttctctgctcctttcatttatcaactctccttcggcgtcaaaggtatgcctacttggactcttagtaatcaaatatagctcggcggttgtctccaaacttctttcagctatgacagaatttactgccatttatatctcttccagctggagtgtttcccgaagcaagcccgacgtcgccctgtctcccatccatccacaacgctctccagtggcaatttcttgaccattgtttactccagcggtcgtctaagcctagaaaggatgtcaaaagaatgtttagcgactacagactatcttcttcgaggttttgaaatcgctcgctccatcaagcaagcgccaactaccagggtgcaattcttagtttacctcggtacaacatccgtcaaaatctcacctaagcgcgcacggccgctctttcttccatttctccccgaaacgctcctacttgggcaaatcatctagttgttggttggtggtgggtacatggtgtgatccaaagcatatataaactcttcctgcatattgttggaccctgcactccaccctttctatctgcaacccaaaatgagtttcactgtcatcatctgtcctggggcctggcctctggtttctttctttgagccacttatccaagccttcaaggaccgagggcatccagtcatttgcaaagttccagattcctacccaacgttcaaccccatgaatccaccttccctgaacccggatagtgaatttcttcgtacacaggttctagtacccgctattgaaactggtgctgatgttgtggttttcatgcattcgtatggcggcgtatatggagctgaaacgctcaagtgcctgagtaagcaggaaagagcggcgaaaggcctggagggtggcgtcattgctgctattctgacctgtgcattcgtggcccccacggggaatacggcccttgattgtatgggtatctcagctggtagtcttcccgagtggattgaatacgaagtatactgaaaaaacttacaaccacttgatgattacttacgtactaaccaccctcataggaatcgacaggtctagtaggcatgaacaaggcatatgccaagcaggtcctcttcaacgatctccccgaggaagaaggggaaaagctggctaatctgcttcccaaacaatctattacctgcttcaccacgcgagtgcgttgggacccatatcaagaccccaacttcaaggcgaaacttggcttcatctacaccggggccgatcggattttccccattgaggcccagcggcaggctgtttccaaagcagaaatcaagcacacctatcttttggaaggctcatcacactcccctcatctggaacaacctgaacacttggcgggcttagtaattaatatggtacgagatattacaggcagcacgaagatttagagggaacaatgcctatctggatatatacactctgtctcttgggatgctctaagtacgtacaaaactgtgtctagaggcctagaagtatagccaatctgattgaatgcgaccgctcacgttacaacactttgccattttatatcaaaggattcaagacttcattcaagtaaagtttcatcatcttgatcactcatcttgatcacagtgcgaatcctctagccaacatcatcctcactactcgtaactccctactcatcacctgtggcatactccccagaccaaatcttatcgctcaaagccttccgctcaataaaataagccgcgagatcgggtcttccacgtaggatcaaatcagcaaccatccgaccaaaaacggtctcgcccgacacgttgaggtgtgtcctgtccgttgggctcaagttgtacttgtcagcatcggtcgagccgatggcattgatatagtcggtgctggcgcggttcaaatcctggtactgtattccaacggctttggccgcgtcaatggctgcctgagaatgctcggccaagttctcaatgacctttccacccgagaaggtacggcgagtaagagaggtaaggatgatctgccaaaaatatgagtctcagggggactccattcaaaagagggagttacgccagaggtcaatgtgacttacaggagtcccaccagcgctgataacctctcttgcgagctgctccatgttggcctggaattgcgccaaggtgatattcgcctccgctttttggtcgttgtgcccaaactggatcgtcacgatcggtcggtagttgcatttctgatccttgacggcctggattgccttggcccaatagccgcctgatctaaaggaaacagttgttgcgccgcttttcccgatgttcacgccgcccgtggtattctgaagaaacctcaagaagccatctccccagcctccatttacggcagtagtcgagtctcccgtcagaataaagtatggcggcagttccttctgatggtttgctgtgggcagcgcctgtgtgagggctgctgccagcgtgcacagtactgtactgaatcgcatgactgctctgtccaacagtgcagtatataattcgaatatcaatctcaaaaatatgtacagttgtcatctaccgtcaccactagctaagagccagcatctgccgtattaatactcattgtcatatactcacaagaagccacctctcaatggcagttgatctcgcacccatatcccccgagattttcaaataggaaagtcgcctcgggagaatgtcatcggcttttgattgtggagaggccgtagccaaggacgggatggtcggcacgtaatctggggaggaggtggggagaatgcaacctacgaagcttttattgatggaaaattcgatgacgacttctcgccaattcgacacagcgtttcctctcgcggcttatgtggaattcatcatttaacccagaattctaattggctaaataaaatccattatacggcagacacagacgggacgagctagcactttgctcattttaattcttagtacttgctgctgaatacgtatatgtatttgaagagaaatactatacttttgtctcttggcacgttcctcttctgtatcttccacttccccgataagtagttgcattggttcccattcagcccatgctccgacagaaagcttatatcccttatcgagcgtttggtagacagccgttggagcatcatctaccccaataaaaggttaaaacttatcgatgacaaaacgacctggccacaccagctcgttcatctcctcctgttcataagtgacggtgtttattggcgcagctacaggtatatcatcacgatagttgaatcagcaccggcttatcaaggtattttaagatagactgattctgcttttgctatttttaacaatactacggagactaaaaagtccatgtgatcctaaaagcagatgtatctacatgaaaaagttttggactttctgtgcgatatccatagtgggccgcttgattgagaggagttgaggatggctaagctcaagctcagccatcaacaatttgcaactacactaagtcaatatcagaataggggattacaacccatgtcgtagggttaacaatgaagaatgcgaatttggccatgcagaatcaattcataaaattaagttatatgtttgtcgttaaggctattcacaagaggtcataaaggattttccctcaaagaagaatcgggacaaccctttcctgcagtctccagagctcgtcgaagcgaccttcgcccggcattctaagtaggcaggtctatatgcagttcaaatcacttttcatcttcgcctctaaaaaggggtcactcccttcttgtaaaaacaagagggcactcgtcctatcaaagaaatacccgtcagtaacctcgttccagcatacagggttataactagtagataaactcacctcagggaaaagagtggcaaaaactctgatttcttccgacttgggcgtggcatgatgcacccagtcgagatccatggacgcctttccaatcatgtgcaccatggtgagcggcacatacttgcgcgcaaggcagtcatgggcacccgcgccaaacacaagccaattcttggtcttagagtcggcgtcgcctgagatccatcgctctgggtcgaaggtatcggggtcggggtagaccttggggtcgtggagagcaggatagcaggaagggatgatcatagcgccctttgggacggtgtagtctggcgtgacggggaacgccttggtggcagtataaggaacgaagatgacgggtgggcggtatcggagcagctccttgacgacagcgttggtgtatggcaatctctcaaacatgtccagctcaaaggggcggcttcgatcacccccgcggatagcgaggttctcctcgcggaccttgtcgaggacgtcgggtctctgggccataatctggaaaaggaaagtagtggcactgctggaggcgtcctgggacgcgaagagaaaggtgaacagcacctggccgatctcctcgttggaaaattcgcggatcaggttctggggcttgggcacatccttctcgccagcctcgacgcgctcacggtacttcttggactccatcatgtggagaacccactcgtcgacggtgcaggttggccgggctcctgacgccatgttgaccttgcaacgagcagcacaacgagcaaattcagcctggacttcctttgccagttttcttcccttgtaagtcttggttccggggacatagatagaaaggggaacattgacgagttcgagggcggcggtaaccaggtagtagtcatttgcaatgttcttgacggcgtcctgagagatgtagtctccgaaaaaggtgcggcaagagagggcacagttgatctctctgaacattcccatgaactcggtcggcttcccccctttatccttgctgattctgacaaacttggcgaaatagtcgtcgtacacgcgctcctgaaccgggaggtagatgctgagggccttgttggtgaaaagtcccgtgagtcccttacgatactcggtgtgcgctttaccgttgaggaaaacccaggcggtctcgccaatgatttgctctgccacggggacgaggcatggcttggtgaaggtgggggatttgaagaccttgtgggcaatgtcccggtccgaagccagaacgacaaacctgaataagtgttaactcggcatgaaaaggtgactccaagcctccttggaaatcatccaagaaatcgacaggggagagaacggagacttacttatggaagacagagacacaactgagaggtccactggcccattgagcaagatactcggtaaattttgggtacaaagcttgaacaaacgggcccataaagggaatcttaaatgccgggccggcgatggaacccttcatcgaccagtaacggactgataatatgagttgtcagcagggccaaacgtttgtcggatggattcgaaatgggcataccctggtcataggctaccagaagcagcagcaccgtgactgtcaattgcagattggtcatggcaggcacatagttggccaaaaggttgttcaccaatcctgtggcctcggtgggctttgcaaatgtggtgacattatccatcacaggagcaacgacgcccccttcaacaacagaagccataatggatgagctatatccgacaagaggtcaaactcacgctcgtatcagccctaaaaatgggagatgcttgattgagaggagtgatccaagtgttctcccctacgaacaagtcgaacattatgtgcccccactcccctttataggttctatccccaacgtgagggaggcccggacaacggtttagactcagggatggggtcatttctcggaaggcgaaggaccacatccgtccgaaattgacagatgttgccaatcgcggactagactccgatatgcaaagcccatgttcccattgctgctcgaacatcagcaatgaggccggaattgaggcgattcccgaattggaagaaaccctgaagcgaagcatctgagacggacgcggagtctagtcccttttaggcttagtctccgcgaccctcatcgttgtgattcgcttcatctcgaatctgcaatatctgacgtgcatgttggagggtcgagggactggctcggcagccgcccagagaacaggttcgttcgtcgtaatcgggttcaaagcggtcggtcccggttcatggtctttggcggtatgatgtgccacgccgggccaaccgacacacgcaccattctcaccttctaagcggggtgggccacacgttccccaggctgctcgtaatcgtatttatcctcgtgtcatctcccagctggaccttttgccaagtggccatgtacggactattatttgtaatcccgcgccgtaggtagtgaatgcatggacattccatagccaacaacgtagaggcaaaaaagcattacccaatgggagaatgtttattatgattcttgcagcatcccccatatctcttcccaccttcttgatatggcctctccctgaggccctggtatccagagtatgcgctcgagacggccgaggacttgctcccactcgcgcagccgaagcgccagcgcggcaatacacgcctggtcgaagaaccattgaacttggggcatgcccgttgatgcagccatgccaatcgagagcagccagatatggagatcgctgtgtaaataatccgtctgtgttaatgtctcaagatgttgtttgagctgcgtgaggatgcaattggtgagagcagcgtgagaataatacgtcgtaccgtgaacaatgagcatataaagaactagagcgtggcgtagacattcgtatgcggcgacgcgtgagggttcaggagaagaattgggcgggagtagtaacagcttatggacgacaaaacaagtgaggtcgtgcaactctgtactggaaggtggggggatctcggtctggtgaaagacggcttgtagatgcgcgatgatgctactcatctcaggatctacgtcgattttgtccgggattggcttgaggatgttggggcccatcgatgccatcttccactggagaattgggccaacgccgtcaccaaaccccaaatcgtcttgggttaggaattggggagcacccatgacaatcattgacacccttggtagaaaacaattagcaaaacgcacatgctatggctggaatgtaaatacataccatgagaccatcctggccgtaagtgggcttgtggtcttgacctggttgatacctcctctgatgcctaccatccgcttgacgccggcaatgtgcattgtgctggcatcaatgtttcctttcccaaactgggagacagtcagtaagcctaacctgttgattcagtgcttgtgaggggttacaaacctcgatagcagccagtgtgacgactgaattcatggtctcatcctggatcgccaatgacgaatcacctatccgcttcctgaccaacgatactgagtccatcatcaacatgtccgaaatggggaaccccttctgtgctctcaactccttgtctagggaggcagtttgcaatgatacgtggaataaggccgggtctgcgagagcgagtggccaccatgacacgacaaagggattggaccccatgttcatatccagagggtaatattggaaggcaatgctggaaaggactgaagagtgtttgtcagtccagtgagatgacatctgaaaaggtatcacgtacaatggtggattaattgttggacatgagcccggggtagcctggtgggcgggtaagagtcgaagggatcaaacgacggatctaccggcttagacagctcgacgaggttttccgcgagaacagagccccctcgtctcgaggatgctggaagaagagatgcgtcatgtttcagggccagtttggtgacctggcgcggcgtgcgggcggtgacgggggatattgaggatgatgaggttagaggctggttggcatagacgcagcggaccttgcgcttgatgcaccgcgagcattgaggcgtgcgaaggtcgcaggaatgcttggatttagcgcaggcatcgcatgagcgacgcagacttgcgcggtggttcatgggcgagggcgaggtgtggtgggcatttagataaacgagcgtggtgtaggtagtacagtgtatatgaacagtggcaggagcagcttcaattgacttgaatcaaagtgggtgtcttattggttccgtcttgcgagaaaaatgcaatattgattccagtggcccacagcgatcagtaagcgctgaatccagctgctttagttggctagagctgctggcccgctgcaaaaccgtcacggggcctcaccagggcgctgtagctaggtatgggcaatcccggccttgaacctcgcgagatgtcagctaagtggccgatgagacaattacactcatgataatggaccatggatcattgtcttgtataggtattacgacagcagaccaaggtcctcccaagactaggccgtaattcagaccgcctggcattccttgccgaccttagctcatgactcaacgcacggcacctacctcctctcaactaacctaccctatataactgctcactcggaggagcaaatctaatgaaatctttcattcaaatcgtttattcaagacgtgtccccatctagtccagcctttttatattatgtgacggaagacagtctgtccgtctttgacctcgtcgtaggcagaagaggcatataggattagctagttggtgccttaaatggccagaatcagtcatgccgcacgttctttccatactctatcacgtgatcgcgaacctacctactggaagcgtttcaaacaggcaaaacattactatcattgaatacatattgtacatatacaatggtaagctaattttatagccatcttctgaatattcaacgaagcaacaagaatggaaactccctgacttatcttagactagcctgggagaaagaaatcaaaaaggcaaaagagaaggtctcagtggggatcgaacccacaatctcctgattcgtagtcagacgccttgccattgggccatgagaccttgtgctattgttgaaagacattctgaatttgagaattatgtttgcctccaattttggtcggacaacgctccaggcgggcttaaaattgctgtgccatgtcgttcgtgtcgctgcgacgttttcaacacgcggtggagctaaattcacacatatcacgtgatcgctttttttttttcccttattcaatgaacaaatagccttttcggataatactccgcttcaattggtcacctctagctgtggcaaatcatcagagttttccctgtcatggctttattttggttcttaggcactgcctttcagatagtgggcctagggtagagaggtaggtcatgaagacagcaagaggcgaaagattggtatccccttgataaacttagaccagatacaccctatttatgagtttgagttaaaaacttaaaggccgccgagtatgctctcacaccacaggggtagtatcgaccttctcagcttccgcaaccaacaacactcgttcttatcgtttgccttcacccgtatatcaaaatctgatgaagtgtatatcatgtctcccaagcaagcagagctcaacttctttcattcgaggaatgaacaactgtaccaactaacgtttagcgtgttctcacctcgactattaaaacaccaagcatcccgggctcgtagcatagtattgtcggtctgacacgggaacccttttttttgactacagacatgttggaccaatggtggatgagcttatcaaatttcgagtcattccccaacgttgatcatttcggatacttcgatcctctgtaatcaagtctacgcccggttcttctagtcaaagaacgtgccgccctgcctgaaggttgcggaatcgggtttcagtggcttctggctaagatgtaagtcggccacttatgccaatatatactctgctccctgcgcagataaaatcatattctaatacaaaacccacaaagaaccatcatagctcttagctacgacttcttataaagtcagaagagatggtaggtacttgatacgaagaacctcagagaagtcggaatcattgttatggcagcctgtggtaggcaagtcatggacgatgatctagatctagttgcgctagctggatagttcttgtaagtgcaatcattggcccggttgacgatgagagtattgtttgggccatcactggcagaaccagcgtgagccaccaaggtaaagccctgtttaccatcattgtcgctttttattagaatgatggtctgcgaagtagctttgcgaatgacattgttgtggtccgctcgaaagttgtcaaaggacgttggcgtgggacggctactgctaggacatcgacggggtggtgctggtggatagagcttttaatatcaacttccaatggaatttccccttgatctaagcctccccgtacgcaatttaaaccagaatctttccaagctaataaaaatatgtataggacgatgcattaataaagaagcaccgagcaaggtagagctacggattgcatcggttttgatagacttcgccccttgcaagatatacagcttgaaaacacgttgtgactcttgtccactgagtatgtgcattaccactagtgcctgtacgtgctcagcctatgctgaaggtgtcatggccgtgtgttctggctcgtcatatatatgttccgtccctggagggcgttgccgtgcaacatcggataaccgtcaatcctggccggcaaacggactcgagacactcgcattcgcggtgaaacctccgacgtaggacatacatgtgacccctcctctgcctgtaacttcggtatggcgttaggccgagctccacagtcaagacaccccgctccggaaaaggagcccgcttgcttcatgccgagcacttcagtacctttctccttcattcgaccccctactaaatctcgcaggaacgcttttgttgaacaatttatccaatatacaccattatcaatcccaaaatgccgtttgacacccctctgaaagcatccctccaaagccagcccacggcctggggcttctggctcacgtgagtccccctgcttatccgtttcttcagcataatatcttgaagacctggaaatgttttgagagcccctcactaataatccgtctcttctcgtagtctgccaagcgcgccagtcgctcgcgtaattcttcgctctggacagtttgcaccatttaagggcttcagctgggttctgattgatgccgagcatggcttaatatcggataaggactactatgaggtatgcttgtccctgttcaggccggtggttgggggggggggggagagttatacttacattgcctagctgtccacagctatcgcctcagagggtgctacacccatcgttcgtgttccttggcacgaggagtggatgatcaagcgggctcttgactctggcgctcacggaattttgacccctatgtgccattctgcagtatgtctacgtcccgaattgtacttcattaccagaatggcgggctctttctaacccatgatctttgataaccgcaggaggatgcgaagcgtatcgtgtcctactgcaagtacccacccgttgggtctcgcggatacggacccatgttcgctcctcattcgcttcccggagtgtctggaggccagtacgatgactcggcagaccaaagcctgctggtcatggtgcaaatcgagtccagatcagcagtcgagcaagtggaggagattgccaagaccccaggcttggacgttctcctaattggtaagcttgaacataatgctcgagattgctatatgaaagagctataaactaatgggagaacacgatattttaggtccctttgatttggccaagcaaatgaacgtggtccgaggcagcgaagagcacgaggccgcaattcaaagaactctcaaggcagctaaggcggcaggcaagaaagctgcaattttctgtaagtttttcacacgtaccgatatcgcttctcgaggaagcacggtgaactaataggggataccaggcacaaacggccaacaagctcaggagcgcgcccaacaagggttcgatctagtatctattgctaccgacttggcggcaatagagtcaggcatgacacgcgagctagccactgctaatggaacagatctagacggtaaggccagagatggatactagtggctagcaaaatagagcattgtacatttgatctatcatagagaattatagattctgatgttcacagaactactatcagccgtcacgcaccccccaatccccttaccttctagctaaaatgctatcaagggaaatttgtaataacggcacaacaaacggtgtttagtctacattatcaagtagactcatgagccgtagatggtggaacaaggggaggtggcccaagaatggccaattcgatatcggtcatcaaccgaacttgggggcgtgacttttgattgaagcgtttaaactttcgtggtttcctcgtctgtgacagcactaaattgtccttttcgcccaatgccgggcaagttatatcaaatgctaagtctgacgcttcgtctcctcgctcaaggagctgacagacgaaaccagatctatttatctctacccaagcaagttctggtaaagagcagccggaaatttctttgccgcctccgcagtatatcttgagcatgcccaaggctggcaatgtacgtgggcgtatcaagcagatgcgacgatagagctcatcaacggcaggataggtcaccagcggccgaacgatatcatctggttcccggcccacccggcccatctcaaaccatattgtcaaaatttgtagctttgggaagcctgctaggacctcaagaacatcataaggccaatcgccatttcgactgatatcgagagccagttcctctatgagaggacactctcgttggattgttaataaagaggaggcatcaatggtctcatcggcccaagttcgtgtctcgttttggtgaatcttaagtactctcagctgagaaccatgcctgatgattccatttagacctagggtattgaatctgggaattgtgatactttgcaaagcgtttgggactgattcatagacatctatgactctctcagtgccccagggtctgtcgaacaccacatgctcgatcgaggcgagtttcggtgctattttgagtgcaaagtccacgtttctaattgttagatgcttgagcctggaccagtcgaaaacctcagcccagtagtccgactcgtgtccgttcccaggatacccaacatgactgccactgatgtaccctggttcaacctcttttttgtatccgaattcatacctgataagtttaaggatctctagtgctggaggtcgttcaccatcaacaaatccgagcccggtatagcttgccgggagaggaaacgagacaggtccatcaccctggggtccaaagtcgatgctaagctttcgaacatttgggctggataagagaatctgtttggcaatttgtgcaagcttaacacagctttcctcatcactataggtgaagaccatgctgagcgaatgcaaactgtcatttcttttcaggagcggtgcggtatacacaagcatccgagcatccagtataggttcaacgacacgatcaagcgaaccaatgctggtatgaagtcggacgctcccctcaggctgtagggccagcacgagtttctcgggaatgcctactgacgcgataggtgggaggtgataccggtttggtggtgtgtacagcattgtgttctgccattccagatcccttagtcctgtagctttctgcatcaactgaactagggcgtctagacatttttcgtcttcctctattgccggggcgtaaactcttatgcttcgaatggcaggtatcagggcatgtttctcgatataggccaggcgatcatggaaactcttctgatgtgggctttcaatgacgaacgtgacatctctatgctggcaataccgcgctgcataatggtaatgagatttgactagtgcgagatttctcattgaccgcgggtggtcctcgtataccatattgaagatgataagaataagctcaaggcccagcatatctagagaagggggatcggcctttttcctcccgagcattcgaattcgaggcacaatctcaccaaacgctgatggtttgccgacatgtttgcccttagaagaagcggtattagggatccgcgtgtgaggatagatcgttcgtttcagctgggcctccaagttatgtaacgcgggtctcgcgttttgaagcagccggcggataggagggacatcctccatcgggtcagtattcgccatatcgaatagctaaacagtccgttccttgttggttcagttaacgttcgatatgaatcgaggatagaaccgagctagagtgagcctgagggaattgcagggtccacgtgtcaggcttggcgcgctttggccgtatgtcgtgaggccagaaagtttgtatcgaagttgaacttaggaaaataggtgaagaggagagtctcgagggaaactagctcacacgtaggaacccgtatgagaacttcgactgagaagtagattgcgcttcaatgtgtataggcgcacaaatggggttttcagcagcaggaaggccattatatagcctatccctgtattcacgtgactcatgactatgatctgtgatggtccttcgaatattttgccttagtatcatctctggtttaaattaatagctactcatcctcatatagttgcgtcaaaagccttatgcgaagtacttcgctgatacaccgacaccaaacgcccataaagagagggaagaaacagagcagagcgggccctgtatacaaaactagcttacccatgtctggattggatcatgacattatcattaggaactgtgattgccggtacacccggaaagctatgggtgatggaaaagtccaattaccatgtggtgttgtatctgccaacctgtttcattgaacgacataaaaaagaagggtagtagagtagtggttggaagctacaccagagacgcatcaatagaaggcttgtgattagcaatgccagacagatagggtctgtgattgctgcggagaatcaagtatttagccccgctgtctaacacctcccttagctttctctatggtgaaatggaacggctgatacagttccttgtctattatacctttttaaataaggtagctgtcatgaaaatccccttgctaaaaatacaaaatatgcgatggcatgaccattcattgttctaaaatctcatcgacaattagcctgtgtcctcaaccagtcaatgtgacggctgttgatattcgctgtcggtttatcgtattatattaaaaatccattgtaatcatattcatttacactctcgtggcatggcacccttcgctactccctcaacggagattcaagcccagaaccagaagtggccagacaccacgcaaccatatggcagaattctcttactaccacttgttgtcgctaatttgagcattggtgggaaccggccgacctccagtttccagatcatcggctgccttggctgatgagacggaaatggcaacctctttcttgatgccacccttggggccacccaaggcggtgttgaggcttagttccgaactgcttcgctcttcgtcgggcatggcacgggaggtgatagttcgacttgtggtggtgtttttcgcagatcgccaagtagagccgtcgttggtgtcgccgagcatgatgctccctggttccggcccagtcttctttgtctgagaagacagtagagagccgaggaagggcttgagtttgatcttgagccagccccagatcacgggcatgcacgaggtgattacggcgacgaaagattcgcggatggcccaggacgaaccttgcctaggaccgtcaatctcgttctggtgaatgcaaaagtcagccacctcctgaacttatactcttttatcaccgttgtgttcgaaaaagtggtagatgacatacctggaaaatgacaatactgcgaacaatggcagcggccataacgaacatagctcccgagaataccacaactagagtcaacttcttaaaggtcgggagttgcgttccccaaagcatgggaatagggatgaggataaggtagatgtccgtcgtgaggtttagtataagcgtcgaaagaatatatagctttgaaagggcgggttggcagagatctattcggggaagtagttagcaacaggcaatcgagaataggtcatgcattctacctacttcctgggtcaggattgatttgccaaaatttgtgcataggctgacagctcagcaggaagcaaagaatcagaaaaaggtatgtaactcccaggaaagcataacctccgagaattttggggcggtagccatgaacaccgtcctgcaagcaaattcaaccagtcaatatactctagatcactcggaaaatatcaaagaacctaccgttaaacgagagtagaatgcacacagggacagcttaataccccagagaactgagatatacatacaccagccagcaacttggaccttagaccctgcgaccctgttatatcgcatttgttagcacacctggccgtcagggaagacagactgatagaggggagcaagtcaaagtgtgagctgacctccatccatattcgtcactttccgggcttaaggcagcacgctgagcgtcggtcatgccactattggagactccatggaattgttgcccaacagcttgtgccatgatactctctgaaatatacgggattatgatacccaacatagcatagtcgtccagcgctagaccgacaaagccgacctgtcgaacgcgagtaaatgtgcgcaacagaatgatcagaaggccgagggatagataggtgtaagattccaccaggaaactgttgagggacgcatccgcggaactcatggcgggcaacagggtggctgtccgcgtgccacaacgttcgaaggaaggccaagttcgaatttgaggccgttcgcaaaactgagactgtggataaactctccgagagaggagaagtgaggatatggggcgttcaagacataaatgaaatctactaaagaggggatggggtatgcagagcggatccgatgaacaggcaccgcgatggccgagccaactctgacgagtggcggtccgcataagtgggtgataaatggagataataggtatcgcgaacctattagcgccaaggtaatgaaataacagatgggacctcttggacgagtccacgtcgatgttggccctgggcgatcaaacgtgccagcctcctgcattgcacgctacctgagtcgtcgtgcatacgtgctagcaggtcggtattacggtgaccacggctcagggatgctagcttcatgcttaggtgctctatgcgttggtccttgtaatggagatgccaactcgagtttgagcaggtcggtcttgaggctcgttcttgagcccgttcttatgatacggcaccacgatctcgagcatctgtcatatgcacgagatttccacccatttctggggaacaggctgcagcagcacgatccaaaaagcaaaaagcttccaccaggaaggtcgaacactcatcggaaggcttgctcatgcttccggccaaccggtgggtgtgaatcagggcacacccctccccttgcctcggccgaggtagtgatcggctgggctagacaagatgattgtcccttggcaaccaacactagaggctcggaaccctacaggtggatcccccacgctgaagatcaagctgaagatcaaggtcgagaagggggggttacccttgcacgatccccccctagcgcggagacttggaatgtgagcgagcggccaaagattgattttctacctttctttccatcggctagcgagggcaaacagaaatggataaatcagcagaacgactaagcgagggcctttccctatgcaacgttggcggcaaagacggtcgagtgaatggacttaaccttgcagcccacggcgggtttcgcgacacgtaaaactttcccaccctctcttctagtggccaacctcctgactagactccattcgagtattccgtaattcgtgctaggttatatcgaatcaagtgtggtaagcagctggtgatgaggattggacgccgtcgggtgggctatcgttgctagggcttgctcaccgtccatgcactatgccctgaggggatgaagcctgctgtgcctcattggtgacattccacgcagtcaggcgttagaatgttttggaagtttgttgccatgtgtttaatatggcatcggcatagaatgccgaagctactctgctggcctgggatcccgcaattaatcgacacgtttgtatgtcaccagccgtgcgggtagatgctggcaaatggtaacggcttatttgagtatttgtttgtcccacctctggatgggaggtgacatgattgcatgcattagcgccatacacagaagcaacacgcaacacaattattggcatgaagacacatgccaagtcgtaaaacgattcgttactttcagtgcacccagcgcggaatagcatctggagagctatcactcgtaccgcaacgccgcacatgtccgttttgtgatagtgttcattagtgagccacccatcaagatgctagggttattgccttcccaatcaaaacaacgatacggggctctcggtgttcagcccttctcctaaagacgcggcccatcattgcctagggactggtcaatagaaaccgttgagctagtttgaacaagatcaaacacgagcccccatccccccaaacccgtaggcaggcgggctcttgcatagccccatgcattagatatttcaggtcagggaccaactttcgaccgcctgataaggcggtattgaaataccactgccagatgcgcaagtttccttccgggctagactgtagcagggtgctaacgattttcgtgaacccctgacctgagccgagtcagggggcgcggctactctgcttcgtgctgcgggcttcggccacgacccacgcgctcaggattatacgcccgtacgtattactctatcaaatttcctgtcttaccgtaatatgccgatcgcacatactatatcatgtcgctaatccatgagtctcgcatctgatgtcgatgccatactcctgctggtggttgcttggacgaacttgtcaaaagcaaccttctgcgccatcctaactagcctgggattcaaccacgtgtcgaagaagcctgctagctgagctctggcaggaggctgtgaggtttggcactctttagcccatcggcagctccctacccggcgtactcgatgcgattccgatatgctacacgtgagtggcgatccctaaactcaccacggcagtccggtagcatcatagtgcagagctagctatggcttttgattaattgcgcttcccattgagtaattagttcgcttcacaggtcggcgtttagtgtcatggtcgccggaagttccctaattggatgggtgcatctgcgacggaaagctctccaaaaccattggctgcgctcgtttaaacagtgagacgcgagaccggggtgaggaagatttcgcgtgaaacgcttgagtgatgcagggtgagttgtctcctctgcaaaagctttttctttcatgcgcaagtgctattttcatttgctggttcccttttacacgcgaaaggaaatacatgaaactagcaaattctccgatctactgaattatccggggagaatgaccttccaaataataaacgagggggaaaactttatccggagttcatctcaaagcagtcatttcagtggcttaccatagagccatagcacagtctctctcttgtgcccatttcctcataatccaggcatattttcaaggatttatatttaatctcccgagcgcgttcgcttaaactttattcaacgcatccaggggaaattgcttgtggaagatgcggtatggtcaacgtgaacccaactgtgcaaatgacaggggaacctatcataatacatttgttcaatatttttatttcatcatagcccacttgctttgaccccaacggctctgggagagggcatcggctatgagcaaaatgtcttcaccctgatcagactctccatgtcttgattcgtgcagcgcagtacgataatgtgcaaagtttctaccttttgctgttgtcttatttctccctttcctttgccgtgtgtgcacaatttgaccttgaactttatttcgttgactttactgaaagatcgttaagtatagggagaccttcccttcacctaaggtctctcttaggtttaggtgactgggaaaactcttgcttgattgtgcagccctttggtaaaaccaccatacggggccaagtcactaaatggcccagttgcctaaagagcagcgcatactttacgtcgggggtaccttctctagtcaaggagtcaaccctttcttggtagcttagctacccaaagaattgaaacatcttgatgacttcagactcagattttcaattcacggaacggtttctgtggaagggcgtatctcagtgtcaattatgtgggcggcaaaatcttcttctagcaggttggctttcgatagaaaatttgatgatttggttgtgtctcgttgcataagctctcatgcacggtcttttatcttccaacttttttttagacgtcggtcggataccaaagtcaccttcgaggtcaataagctcgcctgaatttcatcctcaggtcattttattgcttcaaagagtcgaataacgaaggttataagaaagacttcaatatcatctcaaatacaaccacgtcgttaccagcctgctccaggtgtgcgcaagagctctctctaaggaataaaaacagggaccattcttaatacaatgatagagaagcagagatttagagttgcaggtcaatctccctcaagctatgccaagatatcctgaagaaccattatcattttactatagcccggctctcgcttcgactaactatttggccgaaacctcatgtagtctctcaataggatgaagctctgctaagatcatcgatattcaaagcaagtcacaggtagcggaacttagtttcttggcaacttagaaatcggaatagccccgtagcctatcataactcggatcagctatttagaaacgaatccttgcatggctgtgagcccaatcaagatcgaaacttatgcaagccagaggtatgaatttgcgttcgccctattatggcccggcaacagagatgtggagctagacgcagtgaaggttctgacggaacaaagttcattctgccatcgtgacctttccgccagcgtgcctgaactaacgaactctgcctactcctctcttgcttcgttttgaaagctgccctctctagcatggccctgataggtccctcactcaaatcaagtccttgggaagataatatagaagatgtgccctttttggtttcgccttatatcaaattatcacagtagtgagactcctctccatggtaagaggttctccagaggagtaagcacatcaagatatctctgacacgatagaacaaataaatttactgcagcagactattaaaattcggaaagttctcctctcgacgagcacaaaaccacggaagtcagagccttacatttctaagaactagagtaacgctaagacctgtctttgactcattcggaaagcatatcagaaggccatacttgttctcttctacagcgctatgctcaagtatgtcacattaggtgtaaggctagttagtattgtatgccgccagcgttacctattttacgatagcttcagtgagtgaagtaagcgttatatgccaattcagccttatgatatcccttaagcgaggctcataataagaagtctcggccatggttggaagtatctcatttcagacactttgcgcttttcaataacacaatacctgacgatttccctgagaaataccccacagctcgtttttcaatgtatcattcataatctatgtagtctttagttttacggacccgagttcgctaagcttggaaggctcaacaaggcgtattgaggaaagcttgggagatggccttgacgagccaacaaacgtcatcgcacccaggggtacagccctcctcaagttctgatttcgacaagaacagacaaaaaaaaaaagggcatctgggaatttaaacttgattacttgaacttgattaatcttggttcaacgatccgactactattttcggagactattgatcctctccagggtgggatgcccacggaggcatcggattgtagatctggatttacgcacatcatctcgatgggaaattgaagtctttccggtcggactccacggcagccagggcacatccttaatgagagtgggttcctctatcagtagtggttcgtggcttttctcgcctcctctcggtttggtccaaatggcaacacgcgtcaccttctggcacagtgttgcgcttcgttgctgatttaaggagctgcagctctgtcactacaaaaccagtctagggacagggtccaagcaacgtggttcgcgaaggatctggccagggtatccttggcatccctaggggcgattatgatgcttgggacgtgtaagccaccggattgcgatgtgaaacgcttaggccagaacgcggtcgacgcgatacgagagttgcatgaccaagcttgggcttccacaaggctagtcactgccttgttgctgatgggagttgactggcattcagctttgatttttgccttacagcgagtgggaaaggatgtgtgctgtttccgcccagccacgcttaaattcggatcgaagccgagacgatctgatcagggtcgtggaggatgcagacaagcaagaatagcatgcaactcgagcgaccgactcgtgtggcgtggatagcaaacagcactagattcataatgaagcatgctatcatcccccgagattcatagtgaagagaccgtgcttccctttggatatccacgacgctctcattctcacgcgttcctctactccttctctcttagtgaggcggaatcatgccatggatgtgcgttgggttagctcgaactgccaagatgctgtcgccaacgggtcttgtggatatcatgttggccatacaaagagtgccggggtagaggctcaaacaccatacccgcttctcgtttcctacactaccgtgctgaatttgctgtaccgccagttggtgttggatgagatgcctataacggagtataagcctagtgtcagtctcgaaccacgcataacaattacacaagatacaggtccagcacgaatggtgacagtagcgaagagggtattctgagagacccgcagcctccttctgtgctagtgagcacttcgtatgaggtcaggagcgagctcgaccctgatgaggccggctggggtgggcgggcgaacaaggtgtcgattcatgctggacagaacatagcataatacaatgatagtggcgctccatgtcaagttcaaacaatatctcagctacccttttagcagctaggcaggttgcaaagaggtcaacagaactgtatatgctattacaatcaactgggctagtcccatcgttatttggagacaaaaaaaaggaatatcggatatgaggttgactaagacagtggttgattaatcacttgcacatgccgggatttcaaattgacgataatgccatggtgggaaaggcttggtaaacgtgcctgcgcacaattactgctagttcagcctttctttctattaccttttttagaacaggaaagttggagtctctacctctgcacaactgccacttcgggacaacggcacggctgaaggttacattctgccaacgaaggagggggctattccgaagagagcaggttgaagaaagagggacaccttgttgaactttggcaattatttagggagtctccaatagcaagtggatggactataatttgggaattctgagactttggactaacaatttaatatccatttcaatcattatcaggcattctaactttccttttcgttcatttcacacatacatagcaaatggagcctgggaaggctcctccttcaacacaaaagttttaactccgacagcttggaacgcagtctggacttggccgtgcctgccggtgaggtatattgtccgcatgtccttaaactttgcaggcacacttgctgccagatgacagagcgcattgtctagtccagtgggggagtggacgatcttcaagctcctgatcgaaaccgggagcaaatcggtgatagtttctcgtgggtacactccctcccctggcccgaagcggatcgtgctggtctctacaacgagtgcctcaaggactcgcatgtcccggatgcttcccatgcaatacaatgatggatctccgccgcaccgggcgatcacgtccggggctaaggtaaagtccaccttgacttgctggagggtatcggctctgtgcaatatggcctggaaaacctccctgggtggtgcatcgtcaaaggtatcgaggaaatcagcgcctggagtgtacgaaaacacccgaagcttctttgctttttgcatcagctcctccaaagtcgaaagcccgatgcggcaacgacggagatgcagctcctccaggtggtcgaaggtgaccgtgtctggaatgccccggatcagccagttctttgccttgaaagaggtgagattcggtgcagcctggaggaatatatctgccattccaacgaagcttcgcttcaggttggtgttcatgtggcgtccagcatacgcgatggtgagctccttcaagcgcggcatggaaccgggcggcgtgaaagggaagtgcgtgggattctcccaagcaatctggacgtcgaggaacttcacgttgggcgcgtgcgacatggcgagagaggacaaggcaagcgagctgtggaggcaaaagatgtggtctcgcccctgagggtcacggtgacggctctcgagccaccattttgggagcacctggataggcgtgccccttgactctgagaactcagccagatgcttggtgaggtactcgctctcatactcggtaatggtgtagtccctctggctgtacatctcggatcctacccgcagctctcggacccttgcgccgagatctggccgtttgcaaagggctagggcgagcgagaaggagctcgcagtgccgacgagtggcgagtggtgaagaattggctgcgcgatggttcggagcagcgaacaggtctgggagagggatgacagagctcggagatgcgccatattccaagccgagtgttgccgacggatcttgtcggttgtgccgaggcaatgggggcatagcatctggcagacattctcaaggatctccaaagggagatcggtgagagtgagggccatgtctcgatgcaaacaagctgctcgtcgttggaaggagagttttgtcttgagaagtcgaggttgaggggtttgtgtcttgccgaagccggggggtgtgaagaagatcgtggagctaatccctcgcgttttatgcaatatcacggaaatctttcggagtctgcttgatgacagatcgattaaagcgggcccatcaagctcatggcgatggttgccccctattgactgcaggctggcgatggataagattgataaacaggcgtggggatgacttagtgggtagctacaaggataggatgatctctttttagtgataagattctcgtcgagggtagggttgacacatcaacatgtctaatgccccgttgaatggcccatggtggagtctttggctggaactaaacccacaggcaagagtatccacgcctggagaggccccatggagtctgttgttagctaagatatgggaagttgggatatcgggtcataaaaggaatggttcatcacctacgagaacaaggtagtttgatctccaatagagattgccaagcagaatagctttgtccaagtccagtagaatccgggatgccaaggtaagatgaatggggttgatcaggagaatgggtagagcaatgaatctatctgttcaaaacctaagtgtcctttacttaacttactacataaagaatgcattaatattcttcacttctccttagtagaatctcgcctccttcaagcgtgcgccctgtctgaggaatcttcaacaccccctgttcgatcagatccttagccagtcgaggcaagatgccgtcacagcccttggcaaccaggagactcacagccacaggcagcagctcgtcttgccccgtaatggagctatttgtcgccacctcaccaagtgggaagacgttgtctggcacctcggcgaaaacactgatccggccagagctaaacccgagaggcgcacctggtgcttgaaagtatctattcctcggacttggagtgccgctactgcttgggtagagtaagatcgactctgagcattggccgctgttgttggagcgtgggagaatattgctgttgaaccagttcatgaaggcggtcttgttctgcagcgcggcctcataagttcccgctgggagtgcttcggcataggcccatcgcgaaagaggcacagggttcacaaacggtcgacgcccttcataaacagcagcataatctgaatagaagggatcgcggaccagcttgatttgctcgatgccgatgagcgctgcataagtctcccgcagcatgacgctcaaggggtctgatacaggtccagtctcgttccagagagcagcaagatccaatacttccggaccatctgcaccaacgaaagccgccagcttgtccgcaaagtctgcgataagaggctgcgcgccattaaagccataggtatagaccttggttggatacttgatgtctgaggtatatgaagtataattgtcgccatacatagctttgttggcaatgtcccagatctctggatcacgtacaagaaatccgggggtgtccaaggttgggctcagcggcatagcgccatcgagagtgacgagatcttttgaaggcctgtttccaaataagccttgttgaccagcaggtccacggatagacccgccggtatccgaaccgacagcgatatcaagccactcgtatgacgcaacggacgctccagcgccggatgaggaggaagaaggctggttgtaaccatcgccacgggggttaaacggggaatgatagtcgacccagtcagctgtggcagtttctccgttggcaaattgagacagcttctgataccccacgatgattgcgcccgcatcgatcaagttttggatgcatggagcagtggtattcgcttcagggtataggcgccaccaggcacggtttccattggacttgcggaggccagcaagatcataaagttctttaatgccaacacgtaccccggcaagaggcttctcagcagaccgtttgaaatacagtcgtgaaggtactccgatggtgagggcatctgagccatggacctgcgcagaaagaggttgaaaagaacttcctgttgggctttggagcaggccagcgctgaaggcttgcacagtatctctatagagacggaatgcttgatagagctcgccagatgataagtggaggaagtatggtcctgaggggatggtcgaattgctggataaaggaaagaccaacgaggagtcggctccatcgtacagggacttcttggaaatacagccgcctttgtggttggcgaggaaaactccagacaagaagccgggctgccaaacatcgtctttagttgtccagttcctgaagaagtctccaagagatgcagtgtccacgttgtcagttacaacggtgacaggtgcaaagccaaaagcttgtgtcaacgacgtgtgaaccaccggcccatcgacgaccttgccttgggagtacggtgacacaaaataatcgacgtccttgattttgaatgaggcacccgtgctaacaagctgtgaagcagccgtgcccagaagggcaaaaattgcgagccctttcatagccaataacatggtagggttgaaatgaggagcgtcgtggaactttcaactttgtagagatgcccttgcctgtgtgatacgcatctgggctagatccccttctatttattcatttgagtttggccccgtaagcagccctcccgagtcaccggtcgccgggctaggcaatgatcgttttcgggctgccatgcctgccacgatattaccaataacctccaacgaaccgtacgctcggtacccgattggccggttacactgctcgtgccaagagattggttatcgtgtctaaccccagaagctcaaggcacaaagccccgctggatgacgaatggtgaagtcttatctgtggatttggcagtgcttgcagaaggtcattgcgttgacatggattaagccccgtcttgaatggagtttgcggagaaacacaggcgataatgtcaccgtagataggacattatgcatatcgcaaagagactttcggtgagatccctgctggttgatatcgcttcatttccgctccccgctcactgactctaccagggtgaacaattccctcatattgtggatggtgctttcgaaacaaggtaaatgtaatttttcaatatcgatgtgtctctctttcgcaacaatctactctaaagatatacagaatgggcaggatgaattggagataaaagcaaagacaggagtccagccttttgagatagtaaccctttacttgttcaactttccagcacctctaaacgaataagctgccacggccaatgccgtaacactgatagcaaagttgaaccactctgcagctcttaatcctcttaacaaactctcgtcatgggatctataggtgccgttctgtccgcttttgtcattcatcacagcaacctggatagcagttgccacagctaggccaacactcctgccaacttggccaagagtctggaagatggccgcgcccgccgctctgtctttctctgggatcgaattcattacgaaaatagagatgcaggggaaaagcatgtccccgccaatcgtcaatagaaccattgacgggaatccgtaagcccagtaggtcgtgtcgggaggtataggcacagcgaagagcagacaagcaaccgagatgcacgcagtgcaccataataccatgtagtatccatcgacgcggctcagtacctgggaagaaataagggtggctatgatacccgcaatcccgcttggaaggaagcgcaaggttgtctgaaggacgtctagtccttgatagtcttggtaaaagtaactcgcgaagacgagaaagttgttgaacgcagcccagaagatcgcgtcaatgatctgtgctccacggtatatcggcgagtggaaaattgatagttttatcaggggcggtcgcttgactgtattttctaaccagtgctcccatttaatgaaaaccggaaggattaaacaagagacaatgaggagcgtaagaacccacggtgaggtccatccaaccacgttcccggcggttagagacacaaggaagaagaccaaaataacaagggaaagtaggagaccaacccagtccatctcaacccagaggtaataaaaccgcttttggagtgatacttccctgatctcagcatctttggctaaaaatggcacgacaaacagtgacgtgagccatgaacaagccgtggcaatactcatgatccaaaacacccaatgccagttgacttgctgagcgatgacacctccaagtatgtttcctatgaggctacctaaagggaatccagccgaaaataccgacatggcatagatttggggtttgccaggcgggaacacctcaaagataatgcttacggcgcttggcactgcggcagctcctcccagtccgtggaggacgcgaaagaaacagaatgaaacctcattgggtgcaaaaggcgcaatgaggcaggaaatacaaaagctagccagcccaaactgtaagatgaagcgccggccccatatatctgcgagtcgtccccagagaggtaatgaacaagcgttggcgactgaggccgctgagagaacccattgcaggttaccagggtggatgttgaggtctcttcctatgattgggagaataataacacaagcttgagtcatgccaagctacgtgagggaacctgttagcagcgtccagcctgggttggcctagagacggcatatcgccggaatccattcgcgaagcgaacctacagtcagaaatggggagctggccagcacgagtgctagtgcagtagatcttgtgcgtgataaagtcggctttttgtatgtaccatgtgacgttgggtcctctgcattttctgacggcggatcaaagctttccactttgacctcgagcgccggcactgttggacctttcgcatccatggcttcggtgacatagaagaactccagttcatgggtatcatgggaaagaaagcaataaaaagatttatattagacagatttcagttccaagggagcatccctaggcccacaaggctcggcttctgagggtttgaattgtggaggagtgcatgaaaactcacatcccttgccagttccatcaacagagcttgcccttatcaatactcatctaatattacatcataattatgaaattgagaccttgtttcgaatttgagtcaccttcagaactttaagaaaccaagggcaagaaccccaggctccccctgaaacagcattggtacttgtcttacactgatcactcataggatcttccatacacaaaagtagtacacgagaaaagtcaagctttttaacattcattcaatcccgaagcagatcttgattgatgctgcgccaagcctaagaaagatggcagaaatcattctccaatgaccacaggaaaactccatacccccttgcccccttcggcgaatatctttgccgcctctatttttttcaatgccactttggatcgtgtgtactcaagggtccccgatgtggcttgatagcttttgcgtcggccacataatcgaagtttccaaacctctgagtaaacacgacatcctctggtccatgcggcatctttccccctccaaggaaatcgaatggaaaccccggctcaaacaagtaagcctcgtcaatctctgtaatatcttcttctgatagctcgagactaagagcctcaatgtttcctcggagatgctcgatcttgcgaccacccacaattggcacgacgtgaggggctttttgcatcacccaggccatggccacactcgtcatgggtacacccaggcgctcggctactctctcaagaacatcagctaccaggtcttcacgtccgtttttgatgccggtctttcttccatcgccagcttggccacgctgactcttgggcttgaaataaccaccgcctaacgcgccccaggcagcaagtcccataccttgatcacgacacatgggaacaatttccctctcgatgtctcggatcgccgcgttccaccttccttggtacacacagaatggtctcatgccgtggtattttgcgtatgagttgcacttgacgacccaccacgccggggcatctgagataccaagatacagtaccttgcgttcttgtaccaggacattcaggctctgcataagctcctctgctgaagtggccatatcccagtagtggacgtagaggatatcgatgtagtctgtctgaagctttcttaagcttgcctccactgagaggtggagtgatttggtaccactaccgccgtagttgctctgcatacgagtcttgtctgattgcgccttgtagccggaagaaaatttggttgcaataaccatatcatctcgcagacctcgctttgccagccactcgccgacccaaatttccgattcttcgtcttggtacatgttggcgctgggagaagtaagtatttctgttttgacgacccgttccgtggtggacagaaatgtacttgatatactcacgtatcgatgaaattcccgccttgttcatagaagaagtcaagcatctcgaacgcagtctctttggtacactctccgaatttgtccttccatgcttctccgaagttcaaggcacccaaggacaggggactgacatatacagatgcagatggagataagaggcgatgccttccaagagccgtcttagggggcgggcaaggtggcgcggtcatcttgaaagttatggtcaagtagcttgtctttgatcgtggtggaaagaaagtatcccaagtcttaaggaaatatcaaaacgaccccccctcaaagccatcttattgacatttatacgtatcctttaggctttcacgaaagtcattctttatcagacgtatggggtttgggtatgttaactccgaaattccatcccgccattccgtcacaatcatgcaactccatgcccctcatatgcgttgatcttcctaattcagacagaatatgagtttatgacgttacctataggatttcgtcccagtaatcatccaatgaggtactatgagatgagtccacatgatgcagcaagaggatgttacatcagaaggctagttagccaagcatcttaaagcctaatgccgaaggacaggtcaattttgagtctatcacaagaggttgaatcattagccattatggttaggccaatacaacacagctattttattatatcatcatcatagaacgttgattactccctaccccaccaaaaaaagaagggcaaaggcaagggtgaattcccaaactcgtaagcaaaagaaatctcaaagttcatggatttcacctcttggtaaccaagatcagaacaatgggaaagacgccatgctcaacagtaaaatctagacctcattattctgacttctttaatctagttcagttgcagatatattctcccgtctagacatcgttcaatctatgtagataaaaaccatatggaatggagaaaaacaattcaaagagtagcctttcagatcacggaatacaatatccaaccactaaattatttactctaataatccataaagcgaccaatttatacgcacgaagcggtcgaagggttctggttggtcagcttgcagcctagaatttcgtgttagtatctcacgattgatgcaaaccgagggagagactacacttacgtccgcgcttgatagtaccggcgcagtcggtccagtaggcacaagcctcgttgttgcaatagatgacagtgttgtcattcattcttgtgcatgactcgtgcacattcgctgaaaggtggaagggtgtgtaagctttgttaaactcgaaacttagatttgtctgggtaaactcacttactgcctcgtataacccaacaattgttattggcaacccaattttctggtcgtatttggtccagccttggatgccggtggcaaagttaagggcagcgacgattgaattgaatttcatcttgaagggatattgaacaatagtggtaggatgagtgataactggcagtagtagagatgaggatggtggtctgagtctgaagaataagtgtttcccagcgagagacagaggagtccttatatggttttcctcagctagacacgccgcgaaattattctgaaagcagcaggttcgtgtccgtcttgataagcccgttccattagctgctgtttgctctggtcgtttccggtatgagtatttctcactaacacatccatatacgagataacaaatacatcgaagaacctactctgagcaaggactgtgggcttatgattagttgccgggtgtttggggcgtgggacagcatgaagtcgtcatacaccgtaattatattcaaatgacgtgtacctagcctaatagtgggacttcggatgaagtatcaagctttcgtgcatgaaagaattctcggatgccatcgatacgagagggatagtcattgtggcgagcagatttcatgttggcggcagggcacacgcacgccgaagtgccaacaagactgagtactttcatttccaatcggcaaccaacccctgtaatatccaaaattcacaaggaaggaattgagtttagagaagatcgttagggcaagaaattgttctaggcaactatgcatacagcaattcgtcacggcctatacgcagccaactatcggcagcacggcgctgagatccgactatttgcaactgtgacacgcctcagtaggattttcagatcatatttctccgtgtgtgtaagattgccaactactatgaataatcatctccattcgattttgttttgttgaataaaggagaaagctgcattgcgatcatcggctacgttgtctgtatttcccagatttttgggctaccttggttaatttcatggctgacggcccctacctcgtcataccatgcggctgagcagaatctctctcacggattgttcgctactacgatatctggcagcgacggaagaacttccattcatgcctcattagggcgtgcgtatagtgaatccttcggggaagcatccttgaacaggcagtgatgaagcaattgcatctcctggggcaacttggatccctatgtcgctaagatctgacgttgaacttgtattaccgtcgatctctaatcctttgctacgcattggtggccaggtaaaggtttcaaacgggaaagacattatttaccgtatataggaccagtagctatgtatcaacatgctttaactcgtgccggttaccgagagatacctccgggctagaagggggatgtgcatgccaactgccgaaagcgagagcgaaagccccaacccatctcgaactttacataatagtgagcacctagtcaagacattggtgagcattgtaacaactagaaagatggcagttagtcccgtcattgtttagcaagcgctcctgaaccatccccggagaacccatcacaaactaacaagacaacctcgataaacctcccacggataactacaagaaatgttcggatgggaccggagggactaaccataggctcgaacacatatgtcaataggtaacccgtgttagaagtgggacgtaatcagaacatcagctatgaactcaataattaccattcggtcaaaatataggcaatttaccatcactagctgagggttttccaccaatggccaatctctcctcaactcggaattacgacgcatactcagcctgaccatgccgtatcgtccaggctaaagaaacccgcaaaacacaaaagaataattggtgggattgtggagagtctaatggagaacccgattccgttgctgaaagagggcaattattaacttttgacggatcggcgggcctacttccataaatgtcccctcactgagaatatcaatattggccaaggttggatacatcctgtgataaatttcaggtataaatacagctcgaaactgaggtcataaaagatgaaatattgtgatgcaccattgcccgcaaattcttcctgttgattaggtctacaaaagagagggaaaatgagactcccaagtctctatctttggccttgcctcgcggcaatcgcatccgcgcaagctcctctttacggccaatgcggtggtgtgaattggacaggaccgactacctgcgtggctggttcctattgccaataccagaatgagtggtattcccagtgtgtcccaggtaagagcatgtgcgagtctggattccaatccacacaagagctgaccggagatgcaatgaacaggagcggcatcatcctcaactctggtgacctctagaacttctacaacatcttcgacgagccgtgctgccacctccacgtcgacaacatcaagcccgccacccaccggtactggtttcccgaaagcaagcggaaccaagtttacaattgacggcgtgaccaaatactttgctggaaccaattgctattggtgcagctttttgactaacaatgctgatgttgaccttgtttttgatcatctcaaggagtcgggcatcaaaattctccggatatggggcttcaacgatgtgaacagcatccctggatctggaactgtgtacttccagtatctctcagcctctggctcgaccattaataccggggcagacggtttgcagagactcgactacgttgtgtcggcagcaacaagtcgtgggctcaaactcatcatcaactttgtgaacaactgggatgactacggaggcatcaaggcctataccaatgcttttggaggaacccaccaggaatggtacacaaataccgcagcgcagacgcagtatttgaagtacgtccaaacgctggtgaaccgctataagtcgagcacgggtatcctagcatgggaactggcaaatgagcctcgctgccaggagtgcagtactgacgtgatccaccagtgggcaacttccacatctcagtatatcaagagcttagatcccaaccatatggtgacactcggcgatgaggggatgggtcttgctggagacaccagttatccctacacgttctgggagggaaccgatttcgcgaaacatttgaccattcctactcttgattttgggactttccatttatatccaaattcctgtgagtatttctgggggaacaaaaataattgagatgtctgagctgacaacggtggtaaagggggcgtctcctacgattggggcaaccaatgggtcaaggaccacgcagcagcttgcgttgccgccaacaagccttgtctcttcgaagaatgcaagttctagatccctagttgactactaatttcgcagctaacatgacttattagatggcgcaccttcggatcactgcactattgagcggccctggcaactgacttccgttgctacaacaggtatggcaggtgacgctttctggcagttgggtgataccatcagcacagggcagacgcataacgatgggaataccatctattatggaagctcagattggcagtgcctggtcacagaccatgtagccgccattggataatgataaagacgtcatgagagtctgttggaaacttggcaaggggagacttgacagcaaaattgaacatagtgtgaatctatatgtttctaagttttatgatgtaactctacgccaatttcaacgtaagctcattactttcaatcgcgtggaatccgttgtttccgttgtttctttactcccctttgttcgttacagaccaacctgtgtttcttctctattcttctttaccgggtcttcagagccgacctcacagttctattaataccatttcaaatgaggtaccatttcaaatgaggtacttcgttaaattctagtatatgagacttttcgtcccaacgacttggtcggaacagggcgacaataaccaatgtgaataatcattgtgttgagttgccgggtctggcattttctattgctgtttctccgcataatcagtgcgaatgagacatctaagatcccataacttgttaacacgtgggaagatgggaagttgttcttatacggtcacccttagtttcaaagattctcattcggtgattttaatgaccagctcttcttgaatgccaaattcatcaatagctccagtgatcaggactattgtccctaagatgtgccgctcagtgttcctctagtaagtcccaaaactctgcaaaaccaggaaattgttgaggctcatacactatgttatttttcaaaatgtcttgggactctgggtgctgaatcaacggggaggctacgagatggccgccgtggtcagtcgcagtttgatgctcgataccctataccaacacccaaacccatggaggtcggcgcgccgctactgatgcaccgccggatccgttgtctttccttcacttgggaccttattcgaaactcagataagctgggagcagttgccagactgcaccggctgacttgagcgcccgtacctttgggctgatatctgcgtgaataaatttcaccaacgagcttgggttcggacaatttactccattgtgctaacatggcgagcagatcgcccggttcatctttccctatccagcctagtgagcttgggaagccaagccagtggtgaacggaggggcaagcttccgtgtctgtgccctgatattgaaggccgggtatgttggatagtgggtcagacaagtggtggcaacgtggagggagctaaggaggtctacgcgagcgccatgacaagggggagaatcatcgggctttacaggtcgagaatatcaggcatgaagagactgtttcctgtggtgattaaccttttgagatcattctaccgtcagaattagcaggaacttcagcgttggcttctctctgccacttcaacgaaagtctcctgatgtaaatagcacgtggttgttgctctttttggctagccacgcgtctagttcatgagagcccgccttactctgttctatattaagagaaatacactcttatcaaattgttcccaggtcctgcgttcattttcaagtttcagaaactcataaggcagtagttgtccagccgactcagccgcaaccgcctactttaggaagtggcaaggccaaagttgagccatctttcgtcttacaatgccagtcttcagggcccttggctgtgataatgcagtccgcgtggctagccctacgactgaacccgctatcacccagcggtgctcagtagctgtttcacttaaccaaaaagacgaaccttcattggctcgaaatggcccagtggctcgggctccagagacggtctgcggggaattcttttcctagatcaactaccctaaagtgagtgtttttctgggaagcatcgtatgatgtgattgtcatccagactcggtcgtcaacgctagtaaggggccgtagggcagactaaacattcgggatccccagtcggtatttacaaggcttggatggaccagtatcccggcgtctgcttgcttgcttttctgagtccagttcgctgcataaaagtgaggagtgtggattgaccacctcaagttagaggtgacatgtgaccaaataaagagaaatgtgacggatcgtaaattgtcagtctttgctatgagctcgtcatgtcttgttgataaaagcattccatttcaatcgctatttctgttctggtcttaattattattccgttatgaaggcttaatatatgggtatatttattatgatctgcaaactggctactgataattgtcatgatgcccccgaacccccacggctggccgttgagcttgccactacccttcattaagggggcactttctggttgctctgatacagctaaaaacaagcaagaactcgccaagaacatgcctccacaatcaaactgccccgatccccagcgactagctaattacaacccatccgtctcacgcagggccgtttcaaccttgtcccagtacccagcgattctgaacccgtagagccagaagttcttggcattatcctgcccaatgacgcagaacccttcagggaagttgaatggaagctgtgtagtctggatgtagctaggatactgcgacttctccgcgtcatcctcggagacagcggcggggctgaaatcgtgaccgtacaagtcggccttaccccagttggagagcgtcatgaggtgcatgccggcatcaccaaagaacgggaccatcttccctgctgcttggcgttggagggcgaagtatgcctcaacctgctccctcgtgccttgctccacgacagaccggcgaatctcgcgcgcgagatggctgactggcttctggatgatctcactggcgggtagaagggtgtagagcatggtgaagaggttgctgaagtaaggatccttggcagggtcggtcgacatgcccagggccttgcgagcactggcggcgtactggaggttgacggtgcggctcgagtcggctttcatgagggaagtcactgctagcttggtccaccatgctccgaggacatctgcctcagtcacaaatggcttttctgaggatccggacgctgtagcctcagcctggagctcggcgaggatcttagttctcaggttctcgatgaaggcaccggggacgcaaacaatgcggttctccttgccccggaatgctaggtcgatgatgttcgaggcgccatatcccaccaggccagcggtttgcatcaggtgcttctgcaggacgtgcggctcggttgggttcgttcccagcgagctcagagaatcaaagtcatctgaacctggatcgccaccaacgggagtggctacttggtcctcgcggccatgtaatacatgtgtccatgcagtcatcagagctccccagcccattaaatcgaaagatgtgtggttgtagtatagaatcacgagcgtagcatcgaggaatgacaccacgtgcaaccccagctggccacgatcttgcacaagatagtcatctatcttggtcggcgccccctcaggcttgagcaagggcgtaaatatctctgggtctcctgctattatcggtcgggtaggattcggtctcggcagctgcgatgccaacgggtgcgcattaatggccacatcgtgctttgcgtgtgagaaggcaatggcaggtcgctctgctgtaaaggtctcgggaacgtgatactcgatttcacccttgctctatcacttgcagtcagcatccacaatctgtaggaaaacggggcctgtcgatgctgggataaaatgcaacatacgttcttgcggaggcgagcgcccagctttttccatcccttgatggacgcaaggcgctccaagctcgaccgcagcttctcggcatcgagcagcgagtcgtatctagctagggagtacaccacgagagacttgaggagcaccgcgtcgtcccagaagcggagtggcgcaacagtgtcggttgggacgcgcgatggggccttgggcccgaaccagctactcatcgtgtatgctcgctaatgcgccgtgtgtgcaattgagaagatctgcgatgcagggccgttcaatctgtgctttgccgtagcaaaatgcaagcacaggatgttttaagaacaatgggaacaacttcggggggcagagcgaccccgggaccccgtcattgaggggtccaagtccaggcaagatgaacagttcgtggactagacgagttagctgttcgtctgttatcgacttggctaacttaaggcaaccccttttaatttctgcggtatctgacccctacaagaccggtggaaactgaccccacaaagcttgagagaccagtgccacccgtgtggaaacaacgtgcttgagccaggatgtgaagtggatattcaacgggggactaggtacgggtatgtcaaaatcacgtttccagagccagggatgaggatccagactatgccgccagactgggaatttgccgagtgaggcactccgcccttgggagtggctatgtgtaccatccccataagatgcaaggcacatccattttttctccggcagatatccttcgattcgaacaccgatccgtacgttgttgcgagaggaagcaccaaaatggggacgttggaagaaggaaagcagattcaagcgcaagcttatgcgacagcatccatccagccattgggccttggccccgcgtccaatggcctgatctacttcttctcggcccttgtcaccattgttctcggtcttcgagtctatgtcagattcttcagtcgaaaagtatgggggtgggatgacctgttggcaatagctggctatgtacggtgcccaattcctcctttcttccattgtttcttcagatttggctctggcaagaaccattgtaccgaagaataaaaaatgaaccgggctaacggaagggtttgtggatttaggtcgcattcgtcccctccaacgtccttggtgttatagcttcctactacggccttggtgcatataaacaagatctcgaccctgacacgcagtcgctcctccaaatccgcgctatcgaatacttcatgtactatgagatcttgtattttgctgcgtcggcaactaccaaagtctccattaccattgccgtcctccgactatgcgacaaacacgatatttatagatggatagctattggaaatgccactcttatgatcgtggcagctggagcggcaggcgtcttcgtgctcaccaactgtcggccctttgctgtctactggaacgccgacctgtcagtctcttcgggtatcgacttttggaatatttgctgacatgtcttaatagtggtgtatgcacctttggagacaagggtctggccagtctcaagattgtcagcttggttggttcatctttccaaatgctgagcgagtgagtggaacaactttcccgtcctcacacacagaccatttgagatatgtgtctctatcattcatgtgaagtcatatctcagcttgagcggagcatacttgctgacaacacaatcaaacagctgggttagcgcaattctacctttctttatcatctataagctccagatgccctcccgtactaagacagccttgatcggtgtcttgagtctcggtatcttggccagtgcggccgcactcgcccgaatgttgtactacgggtattgggatacgaagaaacacccagataccctgctttgtaaaccttatccgttccaacactcctagatggcaatgctgatgaagaattccagattacactgcagtcatcgtgataacctctgagcttgaggttggtctgggaatgattgcatgctcgctgcccccgctgggtagaatgctgagagcagtcttctcaacgcaccgctcaaacggcaactccgacatgcgctacaatggtcccggtaacagcggtacaccgcttcgaacactaccaacatcaggtcttcgaagccaccctcttggaaagccgtccagcgagtgggctcacctgggtgataacgaaagtgaacggaagagcggagagagcaaagccccgatttaccgtatcaaccgtgagacgacagtgcaagtggaagtcagcaaggctgattcagatggatctattgagaacgcgccaagaaagaagggcatcacagagcattggtaacatggaccatgaagattctcagttcaacagacacgaccattttttcattttctgaacaaaaacatatagactttgatatgctcaccatataaaaaagcatttttagcgaatcgattacttagcgttggccattttaaccagcatcctttaattcacttgtccaatattgctcagttggtgaggtgtaactgcaggagggaaagtccttatttcgatcctagtaacaacagagctgacacagcctttgtgtgacttatctcgaatggtaccttgaagatctcaatcacgattcccatgttcttgattttatcccctgagtgcaagctctgatcccaatcatctgtcacagctatatccttgtctttaactccctgataactcaaatttgacacataagaaattgtattaagaacctggggttcgctatcgaaaggagtaggatatttatagataggatcttattttacaaaaatggttccctccccacaccatatattaccttgaaaatttcaactgcccccccttccatatcggaacatattgcctaaagcgtcttcttcgcctttggcattcgcactagatagtacaaagccagtgccgcaccgacattgaaaacaatgtagacccagccaagcccaaagtctctccatcgattgctgtagctagaaccgatggtctgtaggaagacattggtgtcgctcatggaacaataactgcagctggctgtgctatccgcgtcaagcacgtagccgccccggctggagatgtattcccccatatagccaccgcaagtctcgttcgccggaagactgacagggacccattcattagtagcacactcgactttgttattggccagacctgtcgaaagaaccgaggagacccagtatgttaatggtgtacagcggtaaaggaatatccagaaacggggcatggaatcggcctttgcgagaacaccacagaagaaaaaggatagcatgaagagcaagttggcgaggttcccacccgattcccccgagtcagtgaaggacatgcacatagtcgcaaacgtcgatgtcaacatgatgaactgaaggaacaacagccacatcaatacgcctctctccgttccttggtcggcggcttcagcgtttttgtagaatcccacagggtagtatatcagagcccatagaaacactgacgcgattatgttccaggggatctcaatgaggatctggctgagcataaaaatcttccaggagtatgtcttggatggccgctcacgggcttcgtagagagtgcgctgtgtcacgaaacttggtatctgctgctggacgagttgggagaagatggagcagaattcgaagatggcaaacatctggttttgaaggccctgtatcgatcgtggtccatcgagaaataccaagccaatgaacagactcacgcagatgcacaggctcaatttggaatagatgtaagagggcgtgcgccaatattgttcaaaggcgcgggtcgttacaactagcagttggtcccaaagtggtgctgcgaattctgcatatgcgtgtttgtcgtgaatctctgtagcagccgatttgttctgtctcgattccttgaggcgtttcagctcgttctggacggcttcaaattcggggcttgagcgccagctctgatgccagtcaacctttgactcgcttcccggggcatcaccaacggcctcgaacatccattcagctggattaacaccaggagggcaggccggcgccgaatatcgttcgaaatactcggtcagggttttggaattctctccaatgtcaccttgtgcatatcgttagctcattgcgtaatgggttgaaacacaccaacgattgtacttaccaaaatatacggttctcccattcttggacaagaagagcagcctatcgaatctctggaagagcatggctgagggttggtgaatagtgcaaagaatagactggccagctttcgaaagcttctctagcaggttgagaatagcccaactggtctgagagtcaagacctgatgtaggctcatcgacgaaaagaagtagaggtggtttggcagccagctcaacaccaatcgtgaggcgtttgcgctgctcgatgttgagaccttcgcctaacacgccgacaattgcgtctgcgtattcttccatgtctagcaatttgatcacctcatcgacgtatgcgagcttttcttcgcgagtattcgattccggttggcggagaagtgctgagaattctaacgcctgtgttgtaacattgttagattgttttgcgcagagaaattgaagggactcttttcctattcttacctctctaactgtgcttgtctccagatgaagatcttgctgttgaacataaccagtctttctctgaaaactttcgtcgcggagatggccgtcaactagcatctctcctgtgatgaccccagcgcccaaccgggcagccaggcaatccagcagagttgttttacctgcgccggagactcccataagagctgtgagggtgcctggtttgacccagccatcaacgtgatcaagaatacgccggttctccttcttgatctttagatcatagcatacattactccagtggaaaacactgaccgaagcttgaattgtcctatcaacactggatgaagacccctcaaactgctttgtcactggcaccgggcggggtagagacttctcgacatcagttctgtccttagtatgcgaagcaggcacaaagcctcgtctgaatacaaggacttcacccttggatttcttagcggtgatgtactcgctggcaacaaagtacacaacgtggttgaaaatgatcatggcgatgacgattcccacattgcgccacttatgggcatgatagtagctgtaagcagtgttgatgtagtcctcgccgttgacgtaggagcggccgggaacggctccgatagcaccgcaagccgcacttgagcggtccgcatagtcagggacgtaggtagtgcaggggaagtcacggccgtggaactcattgaccatgagagattcaaagccataggcgaccgggtttaggtagctgatccagcggcaccatgacagcatgtagtcgatgggcattacgaaaccggtgaaaatgatgagggagagcatcaagatggctgcaggtatcatggcctgatacaaggttcgagataacgcggctcttggaaaactgttagcaaatggcgtggcgttagagggcatgtaaggatacctacattgatctaaagaccccggacatggccaaagtgacaagaaacatgacgaacatgtaaaagaaaaagggccctggttggcggttgagatttgtcatgaaatagaagacgctattgaagacaatgttgttgagaatcttgataggtaggtcgagcaatacagaagagtatgattcggctgaagggtggtagaatgcgtaacgattctgcttttcgacgatgggtcgttgatcatacagggtaaagatctcgagcattgaggcgaaggcattggaaataatggtcatgaacaggacgcagctgcggccgtagaacgagtctgtgttcagccccaggttgtagaatagcgatgagagaataagccctatcacgaggttgccgatggacatgccaacaggaatcccggggtctgccaggagacgtctatatccacgccagagacaaagcatgacttgttgagagtagctcagcatgaaaggagagttgagtcgctggccgtgggcctgtactgatttcttctgctcccggaaagtcagggcgtctgagccgccaatggggtgccgtatttggtactcttccatctgcatctttaattctcgatattcctgacttgccttccaagcagctgcgaaatcctctgctgtttgaggaggtttgaagccaggacggggtacgcgctctgaaggcgaagtcattgatgtcaagaaatcaggtgtggtctgccgagcatgaggctcgaatccgaggttgatgaaatatgccttggccttggatgcagggccaaagtatatctgtcgtccttcgtagatcaccatagccttgtcaaacaagtcgaatgctgcttgtggtgcctgataaatcgataccgcgcacgcctgtccgaacagctgagactgcagtcgaagggtcttgcaaaactcgatcgcgttggcggaatcaaggccacgtgttgagctagaggcattgattagaaatatgatagagtgtgaagaagaggcggaaggatcaacgtacttatcccagcactgaaatggggcatttgccaaagtcgactcggcgatagtgactcgttttcgctcacctcctgagacgcctcggacgaagtcattgccaactttggagttgagagtatgactgatgccatacacggccatcactacatcacgaaggtgttcacaatacctgtcatggaaaggtaagtacatggaagaatggggggggggggtctcctgaacatacctgtctttcgaaatacctggcggtaatgatctcgggcaccgagcttgagatgcaaattgcaaagtctccccgactgtgagtttaggaaagtgaacatctgtctcggcagtatagatagtctcgcccctgtgagcggtatgcatctcctgagatgaaataccctgataattgaagtgtgtgtcctcggaaatgtgaattccatttgtctcgcccgcgatggacttcagaaacgtcgaacatcctgatccaggcggtcccaagacaacgcacatctcgccggggttgatgataccgtccatgtcatgtaaaatgtcaatgcgtcggtcatttgtcgaatgcaggaacaggcgacggatcatatcgggcagcgcaagccacacgttggcgacatccttctggaaatcgatcggagtgccaaaaccgaagacattcatgttttggaagcagagaccagtttgccggaacggtgtgtcggaggatttggcagcgttcactaccatcatcgcccaggcttttgcatcgaatttctcgccatggggattcaaaggggagcatgagtcattgctgacgagggctgggtgttcactaccaagtgcagactggtcagagaattgtcgagcaagttgttcgataatcggatggcgctggttcatgtctggaaaactgctctcagccatagctcccgtcgtctcgacttcgatattaggggtcgacgccagtgtcgaagacgttcctggcgggttgacggcttcctgttgcttcatggcgaggtagcccatgatacgagcgtgaagggacgggaaaagctcaaattatctaccggaactaaaggatcctcttatatgttccgcctgctgggttaggagaaacggacacttatgttctcggccgaagtattcagtcagcagagacggacataagcaactcgcgcatgacgacgacggagtatggctgagaagcgaaatttgcttcgtttccagggtagaaacaggtctcaaacccttgaattcacgtaagcgaccctttagaaatatgaggcttgttcaacttctcatctcgaggtttgcatctgacgaagctggccctggcgggttttcgcaaacaccgacatcgacggatccagctctagatgactgataaattcaatgtcagagacactcttgatgataattctttatcaataatgattttaattcttcattaactgaattagtggtgatgctgggatgcgaaataaaccaggggaccaatagaatgtccaacacgctgctgtcgccgcatactgcccttctcgtgcgagcaccaaatctccgtgtcgggaatatttccgccttttagattgaggctcgacctatcatatctcagttatgatgacacagtataaatgctcaatataagcacacttgaattgtatcttaaagaaattgattgataggaagttacgaaatataaaaaccactccccccttgaggaacaaacgcctcattttatagacacgtagaaatcagatgccagcgagtaatccagcccgtctctcgcgcagacagtatcgcgcaaatgcaatagaacccaagaaaacaagtcgttagcgaccttgacaggagaacatgtcaactcacagcggctgatgttcatatcattagacgataattatccgcgatcaggtagtagatagagcgggcttggaagcagtggggggtgattggccttatgtgctttgcagaccacgtcaaaagcttgaccgagattcagccgcgacgttagaacttggcaccctcgtgaatatattatattggcgtgcagaatgctgtatgtagatgtgaggttgcaccaactgctcaatggggtaataaatcgagcaagatgcgttgcatcataaacggttttgagcttctgtctcatcttttaggtataccaagtgaactgctagcgaacaagcggcttaatgggatcataacacgaacgcataatatccagtccagggtatcatccaagctagaggtcatgctgtcacgctcggacttcggggccatccgttttgcccgaaactccatggtgcagatatctattacttttcggtttaaaagtacgaaggcttctttttttcccttctcaaactttatggaagttgagaagaaagctaacagacttctcccttccagtgtggggtgtgcagaaataaacgacgagagctcaagcactttaatcatctgttcattaaagaaaccctatttctaaagtttacagcataatgtccaaggttttcgtgtacagtttcgctcccgttagggtttatccttcttacatttattaaagcctacaacctaacattgattgcgtgcctcgatgagtttccacagaacctacgaagccagctagactcaaagctcgccaacttctatgaaggccccaatcgcatgtccgtaaattcgggccaacgcagctatcacaatattaacccattgaactgcgatggtaatgtatttggtcgatctctgggatgcaagctaatgcgatcaaagctaaaaccgtgaagccacgagctttaaacattccagctgactaaagcgaatttaaattgttcgtgttggcgcgaactgaggctgacgcaatcaaagaggacttgactggttcgaggatttacagtgtgcgacgaggtcttgatcgcatgacaagatccagggttggctcgatcaatagattattctggaagcctgccattttggaagctctcaggggtcgtcgtcacatttcgatacgcggcgtccaatccagtggccaccggacaattcaatcgacgaaggtccgagtgaagacttggcagtatatctatacagacagacgctcacacaatcaaaccttaacgtgttgtggtgacgcgtccggcctcgtccgaagcgtcttggcgtctttgggtttgatttctactctttctccagtctgccacgtgaagcttctacgccctcgcaaaggttctgtaacggccgctttgcttggttaagaaattttcaccgctggccttctttagggatgggcccttctttcactggcagccgtgttgacgccacttgatcgtagcgttgttggagaaataggaacacttacgtaggattacctgcaggcccgattgcgggggagccgatctccaatatttacgtgtagggccggctgagagactgacaagcaagcccaggatgttagctcagggagcacgtgagctagctggatgctttacagacatcaaccgtgcatctaggctggaaatagaacgcccagggacagagttcgtccgtcggcatcatctcgggtgaggagaggagggagctggtcagctggggacgggtacgccgtccgcggatattgattggccgcgccgtacttttggcataacacgatgaaattgggatttgctgtggcggagccctgcctgatcgtatgtgtatacgcgcagtagtgaggtccggctaatagggctgattgcctaatctttctgtctacaatgtggccagacttcacgccatggttgatgtatgtggtgacgccgcccggctctttgtttgcgcaatcgacgcccaatctgccgggagagggctagaacgcggagagggagcagaggggaaaggggattgaccagtccgtctggatttctggaagaaacgtgccgggccccagccgctatttgcattagctcgcgggaacatcatccatcagggcttcaggggttccacaacctggcgtctgagtgttccaggcgcggtaacttcgtctggcttggagcttcccaagcgtaaaagcccatttggtcggccactcggcacatgcagagcagaacaaaggggagggattactaaccgggcgttgtgtgtgggcggcctcagccgccactccctcccacatttccgtgaatggcagacgcctgtgcctgtaagttctagaccactcctgggcgtatgtgtgacagctaatgttctcgcccgaatgacggctttctgttcgcgccagggccaatagacggcgtgatcatgctgctgtacaaccgtcccggcctggaccaatattgcgattcagccccgtcccgagtaattgttcatttaaacgccttcttcccgccttgaaaatgcacccaatatctctttgccaacatcgtgaatattgcgacatcagcttctgttcactgcgcactgccaagggctaggcctgggttccgctcccaaagcaccatcaacctccttatccggcactccattccatttcagccatcatgccagccatacctgactacctctacctgagggatgaaacaacagcagtgacagggggagggtcaacaccaaagattgcgaaaatcaccaaccgccacctctcactcctgaccccttacggatctatcatcatcacatgcggcgtcatcttcattgtactactctctaatatccttgaaagatgggttctacgaatggtatacaaagacatctaccgaaatctggagaagcccgggaatgagcgacgccgccgctcgtttacatactatcatgttggcgtcatgatgctcttttcgcttttctgcaccggcgtctaccccgtcctcatgttccttgtcgggcctggagatttcggtacccacgtcgggaggaaaggcggcggtgcaaccattggagatatgctctttttgtttgccgagatctacacggcatactacctctacgagatgtgcttccgcacgcaattcgccagcccgctcaccatcgcgcatcatattggactactgttggtagtgcaaacatcggttgccctttttgccgactcggacagccacaaggaggcgacgctggagttttacatgtgcatggtctggggtgagtcaaagcttttctaatgaatcacaaaattcagttaactaaccatgacttataggagcatttgatgtggtggtggaaatgcccgtcttcgtctccatgatcgtatggcgtataaagcgccataaccacaaactcctcgccaagatcggtcttggatgctgtatttggatcattgtagcagccaccaccgaggtcgtcgtgaccatctacctcttgaatagatcctggcatcggtggggaactgtattccgggtcatcactcccgtggtattcgctctctggatcgcgacgcaactttatggcgcttatagactttacaacatgggtcgggcacagctgcaagagcatagaaaagaatccggtgccatcgaatcggagtctattgagtcgggaagctccgaatctgaaagcaccaaaaacaaggttttggaatagacgggagaagattatacacgaataatgagttatgagatttttggtttaatttataatagacaagacagcctcgtttgcaatagagtctttttgagataatcttcccatcgctctctttctaagccgcctgaatggtaccttcgagcctgatgtctctgctgcttgctcccacactgactacgaactttcctgcgggcacagtccaaacttgtgcggccgtatcccaaacactcagatctctacgaaggagggagaacgttgcaactcctgatgcacccgcctggagcgggagcttgtcataacctcttagttgacgaggaggtgtgccagcggagtctgggaaggatatgtagagttgtgccacctcggcgcctgcaacaccgcccgagttggtgatggtggcggtgactgtggccacctcctcgaagaggtccgcatgacctccggggataactgggccagtggcggggccgctactgatctgtgaatcaatagtgatatcggagtacgaaaagttggtgtaggctgtttgttagggcgagatgttagtccaacaagatccgcaaccaggggggactctcaggagtcagggatgaacacttagattccacttacacaacccaaaaccgaactcaaattcaggctcaattcccgcgtcgtcaaagtggcgatagtcgacgagaagtccttcgctgaaattatcgtcaccgttgacaacctttgtgttgtaatcgcccgcactcttggcaatagtgtagaccaacttcccgctcgggctcacatctccccagacaacatccacgagggcattaccgctctcttgggatgggagtccggcccagaccacgcccttgaccgaaggcagctcgaggaggggcgagagggtgacgggcccaacagagtgcaccacgatgatcacgttctcgctgaccgctgccactcgccggaccagctcagcgccattatgccacggctccagatgattcctatcaccaagatgcccctccacggtcagatacccctctcccgcatcgctcgtgagaaagactagcgtgacgtccttgccactagcagctctggccccagcatctggctcgtcagtcccgcttagcgtcacggcggcgccctccttatccgctcgccccttgatggcatcgtatggcgcgataaaatacggatacttgaccgttccagaaccccagcccatccccagcgccccgttgttgcaggccttgtcctcgcacacgttgttggcgtggtcgcccttgacggccccagaccccacgaccgcgatgctcagagggccagagagtggcaggatcccgccctcgttcttgagcaggacggtgccatcgcgcgccaccgcccggacgttgtccgcgtggttggccttgacgtcgcgggtcaggtcgatggaggggaagccggcgtcctggccggtcttgtaccacgccgcgaggatgcgcgtggccatgtcacccacgcgcgcctcggacacctggccggactggatggcgcgggagaggttgtccccccagtagacgttgtcgccggcccacgcagaccccggcatggacatgtccaggccggtgttggcgctctccacggtcgagtgctgggcgccccagtccgtcatgatgtaccccggaaacgcgagctcctctttgagcaggccgttgaggtagtggtcgttctcgcaggcccaagtgccgtcgagcctgttgtagctgcacatgacggcggcgacgcccgcgtgaacggcctcggcgtacggccacaggtagatctcgtgcatggtgcggtcgtcgacattggaggacatggagtcgcggttgagctcctgctcgttggcgacgtagtgtttgagggtcgcctggacgcccgcggcctgcatggccttgatggagatggccgagttgaggccgttgaggtaagggtctgatccccatccctcccagttgcggccgccctcggcgatcttgccgatggcgcctgccacggggccgaggaggacgtgaacaccaagtgctttggcctcctcggcgtggaactgggcacgctggcggatgaggtctttatcccacgttgaggatgcgtggacgctgggggtgaaggccgtgacggacgatgcgtaccggactccaagaggtccgtcttgcaggcagagagtgggatatccgattgaagcgacgggataggtgtttcctacgcatgggcctttattccagccgactccagttacgatcccaactttgtccgatgtcgtgatctttgcaacagctgctcgcgcctttacataggcctcttcccaggtaagctcagctagaagttagacatgtgttagtacatcagatattaagtgtttctctggtttgagaagcattgcttagtggtcccataccagtcaccaaaggcaggaccgccatggccagcgccgccacaaatgagtactgcatgatcgacggctcaaagttacggtgaagcttctagacaagtgctgtgatggcttgtcaggtgccgggttgctacagaacaacaaccaaggtgaggcatcccatctcctattatacctgtccaggggcaacacttgcggcgatattcttcttggctgccttaagccccttccattgcaggacaactttaagcatgagtgatgtaggccaagccgacgactgcatgacactcatttcgtcaaaaagcgctcgaatggctagtttccggaggtgaggcccgtgagacgtttttaccggaaccagatggttgcatcggaaggactacaaccggcgggggattgtgatctgctggacattgtgcctgattgcaacgcatgaggatctccacaaaccctttggggaagagccgtgcttcggtgcatttgccgtcagtttcgctgcagatcaggacgggcactgagcttggtttcccctcatcgggatattagggccgataagcttctgatccttgtcagcttttatggttattttgccaagtaacggaacaggtttatgggccatggaaacaattaggtaaatatctgcatgttctatgtccatgtatccgtgaggggtagaaagcgatgtcacatggggcttcatctagctcctcccagctgtgcacacaaataaccaacgagttgttctgtattttcgaggaatttttgaaaggataaaagttagcttatgctcgggtgatggcgaatgttattctggaggtagaggtcaaaggacggtgcttagtttgaaatatgacaacacttggatctgtcatgacagtactccgctgatctcgttgcttctagactcatagtagtatggaagctgttataaagtggatagaatttcatcatacgcagctaatacttcctgatttgtgatatctgataaagagtgtccatttacgtagctgaggtcaactctcaggcctacttctcgcgagatgaattccgttagcacacttcaaatcaatagaaccgatgtcaattcagctagatgaaagggtatataataattattacttcgggctgagccctagatgttgctgctgtggatcctagatatccatctagatagactcctccacattctcctcaacagagctgaccttggacttggactgcctccacctctgaagaagagggataccaaccccagtccagacagtcagggccacaacccaagacagcgcgctgccccatccgtgggtagcgacaaactggggcgcctggctgctgggcatctgcagctgctggaaggggatgacgacagcctggccgacggacaccatgaagccgaggacaaacgcgcgtttctgctggtcgccgccgcaggcctcgttggtccacccggccaggaggggcgtgtagcacccgtagcagcccgcgaggatgaacacggccagtcgcagggtgtgaggcacggtccacgcggtgaggacggcgtagacgaaggtgagtagggagccgacggcgaagcagacgggggcgcggctgccgatcttgtcggacacgtagccggtggtgaccatgaagaggaagttgacggcgccgaccgaggtggggatgttgttgatctcggggacggtgtagagcttggtggacttgaggtagagggtgaagtactggatgatgtaggagccgcaggtgagggtccagaaggagtagccgagggtgaatgcgtagacctgccaggagccaaagatgcggcggatgatggtccagtcgagcttgccgacgggcttgcggccctcctcctcgatgcgctcgcggcagcgctgcttctcccagtcattcaggtaccaggcggtggtggtgtgaggggtatcgggaaagcagatctggtaagatggtcagcggctctcctactgatatttcatagtaggtaaagtatatcaacttacaaggccgtagacaacgacgggaatggcaatgatgaaatcaaagataaagagccatcgccaagcggacagcccacccctgccttccataccagtgtacagagcagattgcaagtatcccgagaacatctgacccaagacaccgctcatgacgaagaggcctgatcgtcgggacagctcactcttgcggtaccagcacccaatgcagtacatgacgccgggccaggcagccgactcaaaaagaccgatgaagaatcgcagagcatagaattgggaggcagtgttgcacttgtacaggaacaagacgaagatggaccaagtcatgaggcatccacacagccaatatcggggacgaacaatggtgatgatcaagttggcgaaggagccaccgataatggtaccgatgctgaagtatgtgttcatccatgagagttcgttgcctgggccgaacttgagctcctcggacatgcctgagacataggcattggagatgttgttttgatcaagctggattccgtcatgtcagatttgagcgagagctggagaggtttgggtaattacctgtttgacaaagaacatgagacagctccagctgagcaggaaccagtccagcttgaatatcagcttcttctcctccttcgaggtcccaggctcgtgccagtgaaaccacccggacgcgggctctgcctgtggggctgcgggtttgccagtagctgacgttacagacgtcgcatccttttctttgctctggatctcaatggtatcaggcgcaacggccttgaccgtatcggtttgagtggccatggcggtgatagacctggcttggtgtactccaacacgaagaagcagtacacagagagcaaaaccaagacgctgaggaacaaagcagtcgatggaactgatccaactgatgtttcaaatgggatatatacggggatcctcgcgcagtatttcaatgcacgaagccgtcaactgctccagctcaggaagagatttccactcgctagcggccggtccctttaacaccagacgaacctatatgcgaaccactttaagcgtctgccgataacgccctttgctggggcgatgataccatcttgtctccagccaatgagcgactgccggcagcaggcttcggccaactgccggttactgcttgaggcaattcgcgtcggatgatccccgacacgctagaccccgaccatggtgtaatctttcaatctgttgcgagggcggggagagcccggccagtgctacgcgagcctgcttgtttggctcacgggttggactgactcgtcggtgtcgggatcttccgccatagcgtctttctcttggaaagtgcgtgagtgagtggcctctttgtggttcatatacacatgatagataggctaagctattgatttcaagcggccaggatagatcacaatggtggaattcgtggaaatcaacggcgcccgtctcgcctaccgcctggctgggcccgaagatgcccccttgatgatcactctccacggcggccgtggtttcggttcgtgttgatgatccatgcctacatccatggttatttattaacgagagtaggcgaccacagatcggatttcaacgtgtacagccaactgagcgacaagatccgcgtcctctcattcgactatcgaggccacgggaagagctcccgaacaaaaccatacacctttgaccaaattgtcgacgacattgaaggcgtaaggcgtcacttcctcagcgatgagcagaccatcatctgcggtgggagtttcggcggcttcctggcgcagcactacgccatcaaatatgcctcgcgcgtatcgcacttgattctccggggaactgcgccctcacaccatcgtaagcgttgacattatctgtctctacagaagtcatcactaactagttgcagatgaggcgggagccataaagacgctcgaagagcgggtgagcaaggtccccggcttctcggtcaacatgctgaggaacaaggtctttggggcgtatgagagcgatcgtgagttccagctggtctatttcgccatgctgccgctttataaagaaacatatgacgcggacgctggcttgaagagtgctctagatattgaatatgtggcagagtcgcacagtaagaagagattcaaccccagcacattcatttcctaatcagtcatagatgacctctactcggagcaagaaaaatattttgattacactgatcgtttgtcggagatcacggccaagacgctcgtcgttgttggggcaagggactggatttgcccgccaggttcgttatctgaataatcaaaccaaagaaggacctgctaacgatgatcatgcagagaattcccagctgattgccgagaagatccctggggcagaattattcacagttgaaggggcgaatcacggtgtgcatgcggagaagccagaggtggtgttgcccaagatacgtagccatttaggaatctaatcataataaacatgaaagacatgctatatatacgcataatattggttacaaaaagcccagctccaagttggtccagccgtactcatcattaggcatggtcgtcgcgccagacacgtgcatcgccggcccaacaggcagcgagctgagcgtctggccattggcaccattcatccctgaggccgtcgttgaagaagaggaatcttgtgccccagcatcgtctgggaatttgtacagtgcgtagcaagtagaccgtccaagaacttgtcgcatgagagccaagaactcgtcgatgatggccttgagcccggtctcgtagtatcccgttgtgacatttatgaagcctgctgtggaggagcccttggaggatacgaggttcattagacgcctaaagatctggacggcctggcgagcgtgtaaccagccttcggggaaagcctctagtatgctgacaatgacggcgacgtcgtcccgggcagagtatgagacacagtcgacggggcatgagaggaagcagtgcagcaggatcaggccgacggggaagatgcggcatagcgtgacgcgattgagaggcaactgtcgctgctggagaagcacagaggtcgactgcaggtgcttctgggccaacctgaaaagctctgctggcgagatgatggagccgctggagttgaaatggcacgggtagtgcagcaggaggagcagatggtagtatctcgcgctcagccacgtcacggaactatgaatgggcacattgtccgtctcgagaggcgatgccagacacccgttgctgtaccagttctctacttcagacttgatctccttggcaatggcctgtcggtctgcctgggacaaggcagcgacctctgactccttcctggtgtggatttgttgcaggatccgatcctccagctgtcgcagatgtatgacatggcggttggtctgaagcatggacgcatactgctggcgctctggagaggcgaactcatcaatggtcagtccagggagcgggacatccatgttctcgtcgaccagcgcgacctggatgcccagcgagatcgccaccatccggtcaagcacgaatatgctccagaacagacggtaccggaactcgatatccatggccgaggacgcctgaaccttctcgtctggctccttgcgactcagacctgctagcatggcctgacgggcggcgaggccggtgatggaccaggtcgacgttcccttagggtcgaagagcgcgtacaaggccagcagcacgaggatctgcagcgcctcaacctcgtcctgcctggtgagacactcctggatgatgtccgagtacgagatgtggaaggtcgacgacacatcctgggggatctggccggctctctgcagcgtagtgcagccgagcgccatgacgagatacaggagggtggaatcggcgccgccgcgtttcctggccagcgtgccgataacgtcggcgttgcgcagcagcttggacttgttgatgaagggatacgccttgtgaatgttgcggaagtaggcgtccacgagccgtcgagccagagtgtcctgcgccagcaccgtgaggttggagtggtccatctccccgtgcgccatcaaccccatggcccccggcgtcgcgatgctgttgtttggcgagccgtcgatggtcatctgcccgcgactgtggcacgacacaggcgagtccgagttgaccgtcgccactaggctcggggtccggtcgtgaggcaggccaggcgccggcatgctgcccttctcatggtgcggctgcgtctttgggaactgcgccatctcgctgcgagcgatgtcctcgggacgactgccactgctgcttttgcgcgctgcgtttgaagacgcgttgatcgacgccgacgccgccgccttgtcgctgccgtacgggctcacggcaccgcccagcagcgactccaggtcggtccccgtgtcgatagactggacgccatcgaggccggggacgtagacattgttgttgatgaagctggtcagccactcgatgcgcgcccgcagatgcagagtctgcgcgccgggagacgtggccggcgtcgagaaggagcacgtgtgcccggcgctcgcacacaggctgcagacggggaacgtccggctgcatttcttcttgaagctgcggcagcgatcgcaggccggcgtcctttccttgccagacctgggcgagtgcgctgatgctgctgatgctgctgctgtgctcgaccggctcagcccaggacctgacgatgggcggcgcgacgacgatgaggccggcgtgagctgctgaccactgcctccactaccaccgccattggtagatggtgactgctgcaggacgtgagatgatgatggagcttcatctcgtcgcagaggaggcgaggctgagcgccgggatgccctcgcagcaggctggcggactcgaaagcggtgcacactggaagccagctggtccggcggcataataggtctgtctcgatgaaaggatcgggcaagacgtatcgcatcgcactgggtcgggatgaggacgactggcttgcttcaacgggggggggggcttgatgctcgccggcgggtcagtctgtcactctgggctatcgagcacgccatcgagctgatgttattggtacatcgtctctggccgggatcctccgttggtgccactaatctcgcaaatttcgcgcacatcccgaccggcggccttgccacggtcttcggtcttatgactttggaccgtgtgaagcccgtgagagtgagtgtgggaaatcgcctgattgtaggttcggtatgatccatcgccggtggctgtagatatttattattgttgttcgagcctcagtcccatagccagcaaagagaagagaaaacagaaatacaatggccgtctctcgggtggccgttatcggtgccggcccgtgtggcctcgccgctctcaagtacgtgatggtatcaagatcgacatattcagcgatgcaaagcattttgattgacacccgtgactatagatatctactagcagaaaagacattctccttcatccaggcgtatgagcagagggacaccttgggcggagtctgggcgtacaacactctcactcgcgaggacaatgaattcgccattccaaggacgaggccctcgaaggacgcagatgtccccgtccaggtcgcagatgcgtctgccccccaattcgtctcggctgtgtacgacacgctcgagaccaacatcccgcacacgctcatgtgcttcggcgacacgccctttcctgctggatcgaatctcttcccccctcatcaggcagtcaagaagtacctggaagaatacggagaggaagtcaagcagcacgtttcattctctacccaggtgctcaccatcgacagggtccaggacggcgacaagaagcactgggagattgagacgctggacctcaaaacaaagacgcagaaaaggacgcagtttgatgccgtcctcgttgcgagcggccactacaatgatccgtacatcccagagatccccggtctggtcgagttcgataaggcataccccggggccatctcacactccaagttctaccgcaaccccaacgactacgccggcaagaaggtcatcgtcgtcggaaactcagcctccgggatcgacctgagcgcgcagatttcaaccgtcagcaagctccccgtcatcatctccgagcgctcgccccaggtcacgggcggcgacgagcagtcaggctggtccaagcaggtccccgagattgccgaactcacccccgagggacgcaaggtgcggttcgccaacggccacgtcgaggaggacgtcgacgtcgtcgtcttctgcaccgggtaccactacagcttccccttcctgcgcggcctctcgccgcccatcgtcaccgacgggtcctacgcgcgcaacctgtaccagcaccttgtctacatcaacgaaccgaccctggccatcgtgggcatcccgcagcgcattatccccttccccttcagcgagacacaggtcggatggatggcccgcatctggtccggccgggcaaagctgcccaccgaggaggagatgcgggagtgggaggcagcgaagcgcaaggagaaggaggggcaggagaagtcgttccacgtgatgcccttcccacaggatgtcgactacataaaccttctacatggcttcagcgagaaggcagagacgaggcctgggctggataatggggggcgaggcaagatccccccgtactgggatgcatataagaggtggttgcgacagcagactcccctcatcaaggccgcgtcaaggaagttgggggagaagcggagggagattcgcacactggagcaattgggatttcactacaccgaggagagaaattaagcggctatgtagacaacgagcatcatcagcgttcatcttagtagacatcagcatcaacaatcaacaatcatgcaaccaacgtatgcgcttccttggagcatctgtgaaaaagcagcaggcttatcgagcatatctacctacgagttagacaagcgtcaatgggattgatacgaagatgagcccattgagcttgactcaggctggtggagaagagtcggggagagtccgacatgcgttatctttccaatagcctaaagcacgcaattcaatattaaatcgcgctggggccgctcaccgggcggaagacgacagattcttgatcgggcgcaggccgacaagcaggccgatgaaaaacgctgctttgggagattttcacggcctcacgcaaaccggcagaccatcgcaaacgccgtgattctaactcaagtggctgtcgggctagtagccaagaattgaaaatcatttgggtttccctcaatcgacgaacgatctctgacattgcatgtttgttaagtctcagtctcacttgagctgagctgaccttcacagccggcaaaagaaggattaaacctcaagatgacagcagatatcagcgttgccattgaccgcggcggcaccttttgcgatgtcatcgcccaggtcgagggccacgagcccatcgtcttcaagctcctctctgaggatccctccaactacccagatgcgcccacagaagccatccgccgcatcctggagaaggtcgagggcaaatccatccccgtgggccaaaagctagatgggtcaagaataggtacgtctgcttcctgagaaagtgtggcttcgatattgatcttgcccagcttcatgccgcatcggcaccaccgtggccaccaacgcgctgctccagcacaagggtgagcgcttcgccttcatcaccacaaaaggcttcaaggacgtctgcacaatcggcgaccagtcccgcccagagctcttcaatctcaagatccgcaagcccaggccgcttcactcggccgtggtcgaggtcgatgagcgcatcgtccccgccgactacgacctcaatcccaccccttacgacaagcaggtcctcgccgccgagtctgaggctaggccggaagaccttgttcgtaccgtgagcggcgactacatccgtatccttcgtaggccagatcccgcagatgttcgtgccaagctcgaggctctgcgcgccgatggctacacctccctggccgtctgcttcctgcacgcctacctctacccggcgcacgagaatctcgtcgccgacatcgctaaggaggttggtttcgagttcatcaccacatccgcccggaccagtccctccatcaagttcctcaaccgcagcacatcgacatgttccgaggcctacctgtatcccgtaatcaagcgttatgttgagggcttcacagatgggttccagaatctgcctcgtcgggttgattttatgtgctcggacggtggactaaagactgcaacccgattcaggggcaacgaggcccttgtcagtggtccggccggcggtgtcgtgggaatcgcccgctcatgttacgatccggacgaggggacaccggtcattggttttgacatgggcggcacgagcactgacgtctcccgctacgatggcaagtatgactatctgagcgagacgtccatcgccgggcagaccatcacggtaccgatgctcaacattgcaaccgtcgcagcaggcggtggctccatcctctttgctcgcaatggtctcctggccgttggccccgagagtgccggcgcacatcctggaccggcttgctatcgtaaaggaggccccctcacagtcacagatgcaaatctattcctcgggcggctggtgctgtcgtccttcccttccatttttggccctaacgccaacgagtctctagatctcgagatcgtgcagaagaagatggcagagattgcggccgatttcaaccggcagacgaaccagagcctgacgtctgagcaagtcgctcttgggtttttggatatcgccaatgagacgatgagtagaccaatccgcaacgcaaccgaagcaagaggcttcgctcctgagaaccacaatcttgtcagctttggtggtgccggcggccagcacgcctgtgatattgcggacaagctggggatccagcgcattctgatccataaatggtcctctcttctctctgcaagtggcatcgcccaggccgacctgcagcacgaggttctcgagcccttcggctccaagcttgacgaagaggctctgtcacacgtagaccagcgcctggctatattaaagggagaagttgcaagccaactccagtcgcaaggagcgctgtttgactctctagtctatgatcaaagtctcgtccttcggtatttcggaacaaacactgatttgacgatttctcaatcagccgatggcaagagctatgcgcaagtgtttgaggccgagcacctccgggagtttgggttctccatgggccgcgatatcgtcgtcgaatcgatcaaggtccgtggaaccggcagctccgtgaccaaggtggaagaggtctccgccttcaaggatctcgcggctcgcggtcaagcctcgacaactgcccctaacgagaccaagcaggtatatatcaacgggtcgtggcaagaaacaggcatcttcagactagatgaggtacccaggggctctaaaatcaacggccctgctcttgtcatcgacgacacgcaaaccatcttcgtatcccctagcttccatgccaacatccttacttctcacatcctcctcgaaaagaactcggcgacagcagaaaaagagtccaccgaaggacatgccagcactttgtcatccagtcttgctctcgccgctggtagctctgctactgtagatcctattctcctctctgtctttgcccaccggttcatggccatagcggaacaaatggggacgacgctccaaagaacgtcaatctcgacatctatcaaagaacgcctcgacttctcctgtgccatcttctcgccagagggaacactagtggccaacgcaccgcacatccccatccacctgggatccatgcagttcgccatccaagcacaacatcgttactgggcaggcaaggtgcagcccggtgatgtgttcttgaccaaccacccccagtggggaggcacccatctacccgatcttaccgtcgtcactcccgtattcatcgacggtgccatcgccttctatgtcgcttcgagaggtcaccacaccgacatcggaggaaagggaatcaccagcatggctcccgaaaccaaggagctctgggaggaaggcctcaacgtgcccacaatgaagatcgtatctgcgggcgagttcctggaagacgaagtccgcgccgcgttcaacaaggcgggagacttccccggctgcagcccgacgcgccgcatcgccgacaatatctccgaccttaaggcccagacggcagcgaatcaacggggcatcaccctcctcggcaagctgtgcggtgaggccacccttccagtcgtgcatagatacatgaacagcatccaggacaatgcagagctggccgtccgctcgttcttcaagaacctcgttgccagccatccggagcccttccaggctgtggaccaccttgatgacggcaccgccatgcaggtgcgcatcagcatcgatccggaaactggctccgcgacatacgacttctccgggtcaggaccccagatgtgggggaactacaactgccccatcagtatctgccactcggccatcatctacaccatccggtgcctcgtggacgtagagatccccctgaacgaaggttgcctgaaaccagtcgacatcaaggtccccgaagggtcggtgctgaacccgactcctaaggtcgccatctgcgggagcacgctcgccagccagcgtgttatcgacgtgatcctgcgcgcctttggcaagcatgctgccagccagggctgcgcgaacagtttcggttgggggatgggcgggaaggatcctctgacgggggagattgtcaagggatggaactatggcgagagtatcggcggcggtgttggtgccagtgagaattaccatggcgagcattccactcatgtaagatttgattttcccctaccgaattgtttcttaaaaactaacgtagtgttataggttcactccaccaacacgcgacaaacggatgcagaggtgatcgagaagcgcacagcagtgctggtccgctcctacggaatccgccgtggaagcggtggtgtcggtaaatggtgcggtggcgacggcatcacaagagagatccaggctcggatccctctcaagttcagtattcttagtgatcgtcgcgtgtaccgcccgtatggcatggctggcggtggtcccgggcagtccggtgccaactacgcatttgtgtacaacgacattaattttttagaaagggtgaaccttggaggaaaggccgtcatgaatctgaaggagggggaatatatccagattaatacgccaggcggcggtgcttatggaagcatagaataaatgaaacagaaatagatattgctcaagcaaagtcccgagacaactacagaaagcacccgcataagctcttgtccgcaataatacacgcattatattaacttgggcgaatacattaccatactaccagtctttagcaagtgcattttaccccgcggcaaccaacagcgattggtgatcactcatgcagccacccatccagctgatgttgaatcacgtgcggtatatgcaggaggcctaccatgagtgttgacgtgacaaactgagaatgagttggcaagatatgaaactctaaccctctcatcacgggacattttaacagaacgcagtctctctgtcatcatatgtagccgctcattatacggggggtttctctttctatcacaatgcaatcgttggcagacgcagttaatatcgcggaggatatttctattctttttcttctgcaccaagtcgttgaattaccaacatctaatgcagtcacacctcccaaaggcagctgcaccgcagcatatagccttccgttcgagaaagaaagagatctcactattattttggcatatatttcctgcatcagagacaacccaagccgtgtccctgccctttgcatcagagaaaacaaagccgcagaccaattagacattctgtttgcagtcaacgcgtccaacgctgctgacaagggcgttcttcccgaagttcagacgagattccaaaagctcttcaaactactatcctcagtccctacatgtaagtccttccgtggcgaagaattgagcttgaaaacgccccttcctttcccggctgacccgttttgaccagccgaccatgcggaagaagacatctttgctgagatagtttcaatgtgtaccactcgcatacttgagcgtttaagaattcttcatcagcaagataagctacccgtagagacgcatcttatagagacaatacgaattctctcacaaaagtcgcccacgtttgtcgaagcagccaaagatttggtccataagataaatatatggaacaagcatcaagccacctcagaactaataaaggtcgtcgaaagtgcgcatcgtctttctaaaatcccggatttgccaactctactggatcaaatctccaataaagacatgtctccaaccgcaagatcaggccttttaaatgccatcaagaaacttgctagatacagaaccgccgccaggatcctgtgcagagtagcaaagaaattcccagttgcgcggaaaatggacttcatccccgtcaatctacccgaagtcgcgttccaaaaggtacaagcgacaatgcaagcacctgggcgggggatatcggaagctttatcaagaacaacgttgtcgaaaagcgagcgcaaacgaatgaatttatgctacagctatctcaaaatcaatcaggaacaagcgaatcaacggttcagggctcagaaaacacaaacgctcaacggagccaagattcatgccgaagtacagcttgtattcttctgcgaagcgaacaacttccaaccacctcctcgggtcatctcctccagtaaggacgcgtgttttctttgcaatgcgttgatcaaggtacatgggaagtatcacattccacgtcaacatgggaggctctatccaggttggcgcttgccttggttccctgcgcccaacagcatacagagccggctggcaaaacatctcgaggaggttattagcggctctgtcagaacgatgatacaaagtcagaaacggataaatcttccgcctccgaatgaaagcacagctctaacagtcgcaatatctgagactactgccagtgaaaatagcggttgtcattcagtgtcctcgcgcagcattagcccagttaagttggtagtgccccagccggttcctccacacggccctagagaggttgcggcgtccgcagtccgcttgccaacacttggctctccctcgctgtcgatcgcaaatgtagcgaaagctcaaggcgaaatagcttcagaaccccaagaagtcgtagacaggggagagcatggaaaaaagggaaattcagggaaagccaaagaagtcgcagatcaaagaggagaaaatggaaagttggtattatcagggaaagccgaagaagtcacagatcaaacaggaaaaggggtagattcagtgttgcctggcaaagctgaagaagccccagatcaaggaagagaaaggggaaagttggtagctttcggaatccccttagaagttggagacggatgagaagaggaggaaaccgtaattcctcccaggaaacctcctaaagtccctccacgacctccacccaaaaataccccgcaggtgttctcagagcggtgggcaaagctttcaagcccaaccccaaaccgacttattcaaggaacgcctcaagtggtaagtgtggaagccaacacctcgtcgagattctacaagggggtttccatgggattggaaatcgaatattccaccacaggtccagcagagaagagagtcgcacgcgatttatcatgcaacttggaatggttaaatactacagacgcggaagccgtccgagccgataaggacgctctgatcgtacatgcggacaagctggaggctgagattccgataccatcgagcgcgctggggaaatggtacattgcctcaaaggagatgatgatccgtgttcaaatacaatagaaggtaattaaatatagagttttggtagattcattgctcaatggcgcctcacatactaaagtcgggattgaagctatccagattttgaaagtattgatccaacaagccctattaagaatgtcagtgacgcagacctatcgtatcgtttgtcgaaactcacccagtcaagactctccgacccatcaatcatatgtgacatgggttcggcatatggaagctccaagtcgatatcaggggctgcttggtcaataacaggggctggtgatggcgtgaagccgtagacgcccttgttagccactttcttgatcatcaattccagagcaagagcagcaatatgtgtctccggcgatgccgagcgatttcccgcccatatcccttgagatacttgcagtgctctatactctcggtttgtcagatcttggtctccagccaccaccggcgactgtgaacgcatccggacagagaggtctaggcacaacaccatagcagcaaggaggaagtcgtgaatcggcaatgacaagaccatccaccgatcatcgtgtaatcggcctccaggcccagaagcgttgtgcagatcttcctgtcgagcaagaatcttcaaggcagcttccacggatgctcgtcgcgacggagcgtatttggggctgttcagatcgtaacttatataccgccggtgaagaatcacgaggcccttgaggtagagaatctcgattgtgcagcgctgcagaatcaaagcgcttgagtccatgaaactacggttcacatctcgccgctggaacgtatccggcatgcttgcgtaaacctggttgaactcggcatctagcgccagcgtggattcgtaggatggcactgtaagggcttgtgtgtgcgccgcaatcttcttgaacatattcatgacgggggctttcacaacagtgtataggacaggggtgtgttcggaaaacgaacgacttggagggagctccttcatatccatgcgaagatcaggataatctagatttcgaggtactttggagtcacagaactcggacggaatcatactcggaaagccgagctggaacgacattaatgcctcgatctggaatatatttagccagactcgtcgccgcatctcgccatcaaaggcagagatcccagcgagatgttcaggatcgcgatgatagcccatgcgaaaggcaagtcgaatcacagtgcccatctcaaaccacaagtttacaagtgcatgatcgcttgtgatgaaagatgtctggagatggatcaagaacgcctcgagcgcaaaggagttcgcagtagcatacttccctaggataagacactggatgagccgctgctgcatgagcctggtagaagggatcgattcatcaatgtcgccagctttggcaatgtttttgagacatgttgcaaaaccaagaagagcgaagagtaggccagtccaaaggggcggtgctttttctggggcatcccagaatgcctcatactagagatatctaattcagcaaggtatgtcatcaactcctgctacttacaggtactaacctctttttgaaactttgcagggtgaacgactcctttcaggtcaagacatgtcaacttctgtgccattgatcagacaagtggttatcaaggacttacctccgacaagaaagcgagtggagaaatagaacgaaagaagccgatcgcagacaggctgcggaggcagagacgtaagtatgtcgcttatatccacgttgggattcgctccaaatagaaagctggcgtcgggctctatccggtcatgttcctggaatccgccatcataaggcgaggggtggctggacccagacaaatgttcccgaacttctttgatgtcttctagaatcgacagccagtggttgcggtcaatgtagtgaacctggccatcgcctgtttcgtgcatatgaggtgtctccggagtcaacgcgttgtcttctccaccagcacgactaggacttgaattcgactctgaaggtgtcacgttttgaaaaggacctgatgcggagggggctcttcgcgtaggatcattcacacggcctctctctgtttgtataaccgcgtctcccgatagaaaagacgaaaccatcacctcaagagtatgtaaccgctctttgaggtcgcgctgaggcgctgagggagccgacctggttctgtttgcattgctcgcatagtggcacagcgaagacttatttcgtttaacacatgagtcgcagggcagctcacggttgcacttgagtctgcggatttaccaatcagtccactgcctggcacgggaaatgagtttcttgagctgactttctggtgcgacacggctcacacgagacgggtggtcggttgcgtttttccacctttctggagccggaatccatcgcaattgaatcgcggaccggacttaatttcaatctggagcagagacagggtgaaatctctggggtttgcgaaaggtaaaggagatttgcatgtcttggaatgtgcacggagaaggctcttgggctgattcaggcggagaggcacggatgctttggagcgagtactgattgctagactagccctgattgcaaggtttctttccatatgatagcccaagcatagtacatcattagcatgtacctgctgacaatctctacatgcgagcgcggagatattaaagccgctgtggggccaaacaatatccccgttccagcgccgtcaaacatcatcgtgacatcaagaagagactttgtcagcgacaggaggatatattaaatccttgaaaaaatagagagtatagtctatgaggtgtttgatataaagcagccgtctatgttgtattgaaataatgttggctcatcaattcaagttatcaccattttcttacactcacattcctcaagttctcacattttacccatcattatttcaatctcaaaagctccaattcataatatcaacatggccattctcgcagcactcgagggcacaggctcggtcatgtactcgaacctattcgtcaagctcccagcccccagctcaaaaaccaatctctcagaacaaatctttgtgatcactggtggtaacggtggtctagggtacgagtcttgtcttcacctctcaaaacttggtgttggcaaactgattattgccgtccgcaacaaagccaaaggcgaggcggcgcgactgaaaattctcgcttctactaagcagcccgagtcctcaattgaagtttggacaattgatatggatagctatgactcgatcaaagcctttgctgctcgtgtttcatccgacctgcctcgcgtcgatggcattcttgctaacgcgggtattatgacgaccaaccttgcctggagcgaaggcagcgaaagttcactgaatgtgaatgtcatctctactttccttcttttcttcctgcttcttcccaagatgcgagagtccggaaaaaaaactggcaatccttgccgattcaccatccccaacagcgccttgcattacatggctccccttggcgagctccagccaggaaaggggagcattttgggccggctgaatgatgagaagaccgcgaacatgggaggtcgatatcctctcaccaagctcctggtgctttacgtcgtccgtgagatcgcaaagagagcaccctcgtccggcgaaacagggcacttcattatcaacacacccaaccccagcttctgcaggtcggacttggcccgggagaatgcagacagtgctggcttcaaggtgtttgagagagttctggctcgctccacagaggaaggcagccgagctcttctcaacggcgtgttgggtggaacagagactcatggtcactatctgaacaattgccaagtgcagccgtaagtgatgaaatcctatcttttgaatctcaattattcattgaacgggatctaaatttatactaggagcccagcctgccacgttacagacaagttcgggcagcaggtgcaaactgccttctttgaggagctcatcggcaagcttgaaaggatccaaccgggcgtatccttgaccctttgattggttttctggtgaatcgtgtggatcttgatttttgcaatcacttttgacgtatattgtacaatcatgttactagagataataattcgttttcaacttattggctgtgatatgagatcacaaattatggagcttgagcgtgggagctttgtaaaatgccggggttatcggtcttgtagaatttccagagaataaattcaaacgcgaaatttttctaagtgacggtcaatcttgttgaaacgctatccatgttctattgtatgggggtgaccttctctattggaactccatctgtcgggacaactaatcaagtgttggtggtcttgtcagcgtgtccccgaattacgtccccgaagaccgattatgatgccgaatctcacactcctgagacaggtgggaacgcccacccccatagcgggccgaagataccttaagctggtatttattcttagaatccctgtcgttttcgtcggtaccttcttcttatgaataacacaacgctctgtgttgatgaatgtagaatctagtgttgtcgatgtcgagattacgtacatccccttacagatagatgtgactcttccaaaatgagtcccaattattcggcattccatgatgggctggtggacgaaatcgaacatgccatctccaagatcgagaccaccacagagtcagagggagagatctcggtgaatattccgtcaacctatttgcctgtgcaagccacccaaaacgacaataaagatgccgtcagattagcaaagtcagtctctctgccagcaggcgaattgctcgagtcaccggcagagagaaattttctggctgcagcctgggcattagtgctgcacctatatgttgtatcggacacagtggcatttgtagtcattgacagccaggatgggctggtgttgtctgagcagctcgttgtttcacagtggtctgcatcatcatcagaactccctcgactgaacttcgaacctttcatcgctttagaacacagtctcaaagccaacactgccatacaatttggccatggccgtggtactgcgacatggaattctttcgactacgtcctgcactcgcctggacgcggttctaaagacctctcattccatacccggcaaccatcagtgccactaaagttcgcatccgctatttggagcactttcattgaaatcaactcccaggtcagggctgcaggtcctcttggtctggccaacaagtaccaaatcagcgaagtagacaagcgggcaattcgttccttcttgccagatcccatttatgaggcgccgcgatccttgcatgagaattttgaacagtctcttgaagcagtgccagactctctagccgtccatgcatgggatggattactcacctacaaggagttggatgcgctttccaacaagcttgcagcacatcttatccagacaggggtgcagaaaggtcaatatgttccgttctccttcgagaagagcgtgtggatggtcgttgctgttctcggtatcctcaaagccggaggtgcgattgttcccattgacccctcgcagcctcatgcccgagcccagcagattgtgcaagaagttggtgcaagaaccatcgtcacatctacttctcaagaggcaaggttccagaccctcgttgacgaggtagtatccgtcggcgccaacgattcactgggtctggggcgcgatacaggggcgagcatcatcttacccaagatcttacatacagaccctgctgtagttatctttacatcagggtcgactggtaacccgaagggtatcataattgagcatggagccattgctacgcggatgattgtcgaagggaggacttttggttatcaaggcgcgagaacccttcagtttgctgcatcgacgtgggacattttcctcacggacattttcaccaccttgaccttccaaggctgcatctgcattccaaacgaagaagatagaaggttcaacctgtccaagttttgcacagactacagggtctcgttggcgctcatcacgccgaccctagcaaatcttcttgaacctgcggcctttccaacgctcaagacactgatctttggcggagaggctctccgggaggatgtgctcgagaaatggtctgcggtcaaagggatttctctcaaccagggttacggcccagcagagactggtccatgcattacagggcaggcacatcgccggccagaagtcttgggctatgccttggataactcggtttgcgtgctagtcgatccccaggatcacaacagacttgttccggtaggagcagtaggtgaactcgtggtgggtggaccaagtttactcaggagctacatcaacaatcccgaaaagaccaacgctgctgtgattcgaaatccagaatgggcccgagagtttgatcttccgatcagccgcttttacaagaccggggacctcttgcgttatagttttgatacacttgatggccgtcttgaattcgttgggcgaacggatgatcaggtcaagtttcatggccagcgcatcgagctcggagagatcgagtaccatttgagcagtcttccagggctagtgtccgtaatggtcactcttgtgaagtctggtcccttgaaagataaacttgtcgccatagcccaggtgacgcgaggcaagagtcctcgggtatcgaacggtgacttttctgtcaacaggggggccgaggtaaccatcgccgatgtcagaaagcatcttctacctcgggtgcctcaatacatgataccaagcgaattggtggtcctccacgagatgccgctaaacgtgtccctgaaactcgatagggctcgtatcagtaaatggctctccgatacgcaaatcaatgtttcaaatacaactgctccgtctccaaaacatgagccaaatacgttgctggcccatgaagtgacagctcgacaggtggcaaggcaatacgcatcgattgtagctgaaggcaaccaacatcgccgcagcgaactcgaagatactgacttcaacctccaatccggagggattgattctgttcaaatcatctcacttcattcaaatttgaagagaattttcaaagtaaaaatcccaatagatgagatccttagctccaaagccactgtgcgctcgattgcggcagtcattgatgaaaatagcccccagcaccggcccaatgttaacaccaatggggtcgagcctcatttcgactttaccgaattgggcttgcagcgcagttctaatagcccaatcattcaccggacgttcattactgggggatcaggtttcctcgggattgagattttgcggcagcttcttagtgatcccaatagacacgtatatgcactagtaagagcgcaatcagagaaggctgcagaagaaagacttattcgaaaggcaacagaggcaggttggtggacgaatgcttataagacaagactccatgtctggataggtgacttggcacaggctcaactggggctgaataggactcagtggcaaatgcttcagggcctggtagctccaagtattgattccgtcatacacaacggagccaaggtgcactacaatctggactacgatagtctaaaacccatcaacgtgtcatcaacggttgagcttctaaatgcgatcaactctcgcaaacagccactcacaggcttcgtgtatgtgtctgggggccagcaactaagtttcaatgacaaggacgaccagcagaatgcgaacaaagctataaatgggacaggctattcaaaatcaaaagtggtatctgagttgattatcaacaagttttctcagactcatccaagcaagaacctgtcacccatcaaagtggtcagaccagggtatattatcggagactctgaaagaggactggcaaacaagtcggacttcatttggagattgatatctgcctcaatcgagattggaagttataacacagacgaagaagacacttggctgttcgtgtctgataccagtcgtgtttctcaaggcatcatcgaagccttgcatggccataatcgtcagcaagtcaccaaaattcttgacggtatcaggttcaaggacctctggaagcttctcaaatcttatggatatgaccttcaacctctcaagagagagcagtggctcgctaaactccaccaattcgtggcggccaagcaagagaagcacgtcttgttcccgctgatgtacatgttcgagtcaaacgagccaattggggttcaaaatgggcctttccagccaagcccaggagttaaggaagcactggaggccaacattaggcatttaattagcgttgacttcctgccgaagcctaaactaactccctatggcacttcatcaggcaatagcgatacctccgggtcttgtgtggatatcccaagagcattctgggatgaagcagccgtgcaaaagaccgatcaaattgatgtccagagcgttcgacaaaaattcccagccctccatcacggaatcgtgccattcaacaacgctgctgggacggctgtccacacagaggctgtcgacaaggcacgagaatacttgtcggcaatccctatcgagctgggacatgacgatattaaaagtcaagagaaaacacagagactcatgaataactatggagagcttgctgcattcattaacgcggctccagatgagattggtaagttgagttgtgggtttgcaaggaattatttgatacctttaccaaagtatcagcatgattttattccagtagatggatgctaattcgtaacagcttttggacagactaccaccttcatgttccgggcgcttgggcaagccttacggccaaatttaaactccgattgtgaaattatcgtgtcaaacctgtgtcacgaagccagtgccgcagcctggatcaagctcgccaaggacgtgggcatcaccatcaaatggtgggcaccaccacctggtgataatcctgtgctatccttggaaaccctaaaactactcctctcgccaaagactcggattgtcacttgcaaccacgtgtctaatgttattggcaacatccatccaatccgccaggtcgcggacttggttcacacagttcctggtgccatattaatagttgacggcgttgcatgggcacctcatcgaccggtcgatgttaaggcattagacattgatttctattgcttcagttggtacaaggtgtttgggccgcacattgctcaactatatggacgccggagtgcccagaagcgagtgctcacgcattcgagccattacttcctttccgaaatgcccggactggactggagactacgcttaggcagcaatacctttgagcttgaggaggctatcgttccaattgctcgttatctgacaaagttgggctgggataacatcgttgcccaggaagtcgtcttgcaacatgcatttttggaatatttgaacagccggccccaattgttccgcgtctttggagagaaatcatccgatcctagtaaacgcgtctcggtgattacatttactgtcatcggacactcctcatctgacattgtcaaaaaggtttgccagaagggaagattccgcattgttgctggcagctgctgggctccaagaccgactcatgacgtcctgggattggatgaggaggggttaatccgagtcagttttgtgcattacaatacaatctcggaggtgaaagaatttactagagagtttgacgcgattctgggctacgcttagggcaattaaagcacacgaggcctttcattaaatagctagaatagtcgaacggcaatacaagaaacgaatagatggatatgtttttttgtttctcatacgagaagataattgtccattgaaaagctccgagagtattaatctaaacgtcaatataatctcttcagatagctttggttcttgtatgaccgattatacgcccaagtaggacaatcattctctgcactcgctctcctctcagtattgggcttctaacacgggctctgactcatgaacctgggactcgatgggacctatgaagcccggaatgtaagacagggctggctggatgggatttggaagttcgggccgaatgagaaaccccgaaccgcttgcagcttgccgaaattttcggcatctgctgcatgaactcgtaacgggtttccttattgggctcaagcttcaggacagccttcttttgagatatactttgatcgatgtagttctacgaggctttgtttttctattacggcgacttgtgacagtcatgtcgtatcaatcggagtatcagcgaatctggaatgaagaaaaaaagaacaaagtacatagaacgaagccatttacgtcaattaataccgtggtaggtatcaggagagttttattgaatctcaatttttatttgccggtcttgatggctttaaagtgaaattctcaatgttttcaaatgtttgctgcgttcgggtaaagacgcctacatatatatatatatgcttgtctttttgaggattctattgtgtgcaggagatggaaaaaacttcatcaaattgtaagtttatctctagaatcaggctgtaattttaagttgcattttcaaagcaagatgttctgttcatgtttatatccaatcttcgaatcgccgtattcaagaaaatctccgattatgtttcgtcggtcccatcacgatctatgcttctcaaaaagatagactcctataaggaagttattagtagttgaaacctcgaatccatgtattgtggtaaatatcttaccgtacgacttctcttggttcatccaagctttagtcaggatccctccagcttccttgcagatttctctagcctttccctcaggccattttccgctccgaatagatcgaagcttgtcacctctcttgaattcatatatctcaccatagacggatatcgaaaggtccttatacgcaatgtagtaactttcatgcatccatacagcggggttccaagtcccaacaaaaccccaatcgcccaagttaaagacttcagcatttaataactggttagcatgtgtcaagccttggaggacaaagtctcggttggagggaccctcgtaggacaatgcaatctcccgttgatcttgggagccatctagcccaacaatcatagaaacgctgttgctaagaaatgctcgtgtgtattccgctgcttcagaaggtgtgaagttggcaatactattgcctaaccagaagacatatgtgtgcgaagagccttcgtgtcccttcagccaagctgcacaatcctcataagtgccgaggagaccgtgaagcgtaatggtggacccggcagaggacaagacacactgaagctcaaggagagattttctcaaactttcttgatcaacatcgcaggcatagtattcgacatactttccctgtgcctgtagagcttgaaggaaaaatgcagtcttcttcatgtttctgaaacatcaggttgtaagcagagttgcataacgcattgtatcatcaaaatgttcggtgttatacttgccctgccccgagttcaatcactctgtcgccaccagcaatggttgcaacaatctcctcgatagagtcatgtaataggagccattctcgtctagccgggtagtaatccggggagccaatgactgcatcgaataaggataatcctggttcgttccatagaagcagaggaggtgattcccgttccgcagatttgagaccttctatgatcccacggaccagatcttgggagatgatctgccgccgagtgtcgaaaatttgtatccgttcggcgtgcgagtctttctcgtttacggggggtttaaccgcacttaaggagtctgatggtaggattggggtccagaatggatcgtcaatatagtttcgtgcggatgtgaatgcggtggccatcgctagggactagagagaaataatggaaaaacttttagaccaggtacaagttcaaaaatagccaagaaacattgtttttctggcggatctttgagattcaagagactaaccggtatccgtaacccccaagtgtgaatatataagttggtacgtttcattatactaaagatcttaactcccctatcggcccgggggtatgataacgtcagttctatactttgtgtgtgtcattcagcagttaatagctaggcgtcgcttccaggtcatccaaaatggtactaaattgccccaaaacagctcaatgatgtttgactggcagtattgtccaccttggacatctgctcagccactttctatgctactttcggcatgcagtcactcggtcggagggtgtttcggccacagcattcggcatacctgagtgagttacacatgtctgcccgagagtggaacgcttactcagtctggctcgtggtcttgatgtatgtactgtgagagtagacttatgatggagtgaaaacctgatagctcgccacgtgaatgatggtggtcggggcgtgattacacaccttgctgatatcataattgaaaacaactcgaacatgactgccccagcgaccatcattatcattggctctggcgtttttggtcgtaagtttcccataaagcgatgtgggccaaggaaagagagagtgacattgaagatgaattatgaactaatgatccaacctaagtttcgacggcctacgctgcaagccgcgaccccagattcgcagacagcaagataattctcgtggaccgctggaactttgagcccggatcctccacaacatctgtccagaatcccggggctgcgaatgccgatacatcccgagtgattcgtcgcgactatccacatcctcacgatgcttatgcagcgcttgccctggaggctttgacacactggagggccgaatggggcgagaatggacgctacacagaccaaagacttttgttcgccgcggagggttcttcaatcgaaggccccaaaaaggatggcgagattatcaactatgtgaaggatgcttatgagctcagtatcgacatcacaccaggtggaaaagatggcttgaaggtcgtcgactccctcgccgcaattcgagcggagcttggcctgccttcgagcaagcccacgaacatcgacaaagacagcagtgccctgagaggatacatttcagacgattgcggatgggccaacgcaggtgccagtatcgagtacctccggcagaaggtggttaaacttggccgtgtccagtttgtcgtcggccaagtaggagaactgatccagtcagatgacgaggcacaagtcaagggcgtcaaacttcttgacggcactgaaatactaggtgacctcacaattgtcgccggaggcggtcagtcgccgcgcattttgggattgaaagatttgtgcgatgtctacaacgacgtagttgcattcatacagctgacacaagccgagtgcgatgagttgagacgcagaaagtggccactcatcgtgaacgtcaatcgtggtgtcttcgcgattggccccgacggtgataactgcttgaagctaggccacttctcccacagtggtatcgtggatgccctcaagagtgccaagatcgatctcgggccacgaaagaagactctgagcgctgaacaggaatgggccgacccggacttcggctggggcggagatgttcaattgaccgagctcggtgatctggttgacgatgacaaagcaaggctcaacaaaactcttgctgattatcggttgttcctcatcgagcttcttgggccatcatcgtttgacagcatcgacactgtcggagatgtcaagtacgacagcgttctgaatagcatcgctgtgaggccatttacgcgggtacggaagtgctggtatactgaccggccttctcttgactttatcgtcgattaccacccgtcatttggcaggagtttatttgttgcaactggcggaggagatcatgccttcaagttccttcccgtgattggagagaagattgtggagctcatcttatatcatcagggtgtgaaggcaccggcccttagggaactcaatccttcagtcgaagagcttagcaaactctggaaatttccagatgatttattgaagtgaagacctctcaaggatgagggcaattacgaaagtacgttgggggtttggagaaatatacatccttgccataagcatgaaagcatagttatgagaaatctcaagatatgatacgatttaacattcctaagtgccataaatcccagtgagagagtgatggatattgagagaatgttcgttgtgtcagtacatgacggcaaagtaaagagctatgaccaaggccacattgacactctgtattgactgatgatgtaatggatattccgatattcatacacatttcacaacctcttaaatccgcactcttcggatgtaagtatacttgctcaactgccgttcatgccggtgatccctgaggacgcatttgccgcaactctactaactatcatgcatctcaatcttcgaaatagcacaaagaagacagataatgatgctcgatagtcgggagctcataatttcggcctgacattccgcatggagtattatcagacacaaggagaaccttggctgagtctagactctacagggctgaggggagttagaagttcccgtgtcatgatcatttcggcacttgattagtgtggctatttgacgatcattaacgggaagagaatgcaacagtcattggttttgtgggttcggaagtgtcggagaacagtcagagccgtcagattgactggaacggtccgagtaaccaaaccacctgaccgtgtatacacgtgaatcattgaacgggacagctgccatgccctgccatctccgccaatgtcacctctccactggagcacggtcatcttttcaaggtctataaacagtttgtgcgtcataaaattatgaaatatgaataagaaaagaagccattcgcgcatattgtgtcttgcaaaaggtgtgcccctttcttatgaagtaaaatttggctgtcttcctctctgggctaactacatcagccacgctgagtcatgataatgagggagaaatgataacatcagcatgaccttaagagcggtgtacttttgctttttgttgttttttgtttgtttcagcatgaatctgactatgttctcacccttccccatctggcaaaatcggcacccaacacgcgtatggacggcaaagagttccgccactatcaaacacccagctgcctgcagggaggcggtttcgatgcctaaaaagcttgacgtaataccccaacctcgtgaagatcatggccgtgtcccatgccatgccatgggtggtccgtccaggagaaaagtctatgcagagaacggaagaagtcaggtagcgaacgccacctccgaatttcacaaccgctccctgtaatgtcacaactggctcggcgggcattgttttctcgaaattggtgctatcctccaaactcatacgatttttactggatcgttgcaccagagtgcctaattctacgacgctgactgcaggtgtggcatgtggcacatccctgcgagcggtggatgtaaaatacaatttcccgaataccgtttgcgtgattgatccttacatacttcttcattaggcacgactgaaatcagacccacggcttgtttagtccccaccagaacgtgcgtttagcagggagataccggaacgaagtgcacgttgcgttggacactgaaccgccgttggggaagtcaggattcgatcctttggcctaggcaaaaagtccccaggatcgtatttgtatccccaactttgagacattgttccccatggtcagcaattttcaaagctgactttatgatgacgcaagtgttggcgaataggacaaaaggaaacagaatgcattacacgtaggactcttgaccattgaaagctttgagcattttgtgattggcccaaacgcctcagtagccgcccttgatcctgtggagtggagtgccatgcagagtatctacctgaaattgagatgtggctatcttttcccatatttggaaagtgtagactgggatagagtgggaggatcttggacttggctctgattgggagtcacctgtccctcaggttcctcccaaggctggctacatagcccgaggacccagaaggtagctctacagtgctggcgtacgcaatacgcagaaatgagcccttagaatgagtaaaagctatttacaaagcttgtacaatatctcttattttacagatcatcaacgtgattttcatactttgattggcttctgagtagattgtaaaaggggttagtaaccacaaaatgttaattgtgtatttcttttgcctgtgccgaactccaccaccgtagaaagctatgtaacagactacgctgtaagaggtacgatatgtcgacttcagaatttattccaggtatatgactgaaataccttacagagcaatgcagttgtaccgatctacatctgacgggtgtctcagcaggggccctctcacagtttatagagcacagatatccggtctcacggtctcggccaggcccaatcctagtcggtgccgtagctgtgcccctcattcccggcagattatatttatctgccttctaaagcccatcaaagcccatcttagtgttgaggaacgatactaccttctatgtcaatccagccacttacaaccattgacatggagaacaaaaacaacagacgcggtgcctgtgaccggtgccgcggacagaagctaagatgtgtcggcgctgcagatcccattgtcatctccggcagtcgctttcaacgtaatcagactccctgtgagcgttgcaaaagggccaaggtcgactgctacagcgttagacctgtgtccagacgcccgggatccggctttgaccagagcgatgagcgtcaagccaacgggtctcaagcaaacggtattggaccaacaccgcaacgatcaaaatgcactgcaaccaacccagcgggcgtaaaccatcgacttcccgagccgatcctagtcgccgaatctcagccaagatacgacagcacgtcccgagatggtctcgatgtgaacatatcatccatgctgccagccaactctgctgaatgggcaatgtatacacatgatgaagaccacgatatggaggtccaagagttggacttagcgacccctgtctggatgcttgagcaacaaaggaccactgggcagaatgcttgttccgatcagtcgtatagggacagcgagctcgatctgataacgagcaaggccggttggaaggaattcaattccagtaaaggtgacttcggcccagtagattaccaaactcggaacttcgccaatctttcacggcaatctatgtttgaatcgaacgaatacgagcgttctgggaaccacaaacaagcgccatcaaagcccaccaacaccccctctgagccatcgaccaaaacttatatccaagaattggcgaaatttaatgaaatgctcctccgcgaaaagggatcttacgaggatgcagcacccggcccggcccagcaaccatcagtaggccagacgctgcatcattgtcagcatttcttgtccatattgaggcggcttcgcccatcctcttacaacccagattcaaatgaatttgcttcagaatggtcttatagcaccgaagaggggaggttagaggacaccccatatgcgccgtcttcatcgcgacaaagcactcaaaacgatacaccgtccactgtatcttctattgactctcctcttgaggtttctacacttttatcaattctttcttgctacacgtatattcttcagtcatatgaatccttgttcactccaatcctggactccgtcacgagctcaacacccacagttccgccgacgttggctggtctccacctcgacggatttgagttagatggctataacagcctccagctagaatgccttctcacaatcagcctgagtttactcgaaagaatagactcaatcctgactggcgtgcctggtggacaaacagaccaacatcatggcggaggactccttggcaacaaactcttcagtggcttgcttgaagcattacacgatcaaaacgggccaaattctttgaaaagccctggtaatgcgaaacgagaagtgaaagcaaaacggttgattcgggatattcaagcaagcttgagacggctggatcagtaaaatagatccgcataaaagtatctggggtaccaaaagcatctatacaaagactccactatcacatagatttgacacatttgaatagattaactttgattacggcacaatttatcatactgttcgtaaccatcctagtccttgataccccaaattcacaagccgagatctgtgaataaggttacggttctgaattcgggcgttttccgtatttccaccttcttggttgctatatccgacctcctatacctcctggaaaacatcccagcaaatgatctgtacgccggcacgccgttcccgtaaaacttgctcaatttgatccccataataaaacagtctaggacccgggacaatccgtccggatacgctgccggcggcagcaacagccactatcaaagcaagaggagtactagaacgcttcctggagcagtgacaaaagtactacccttgttagtctttgacggcaccttgtcggcccggtcagcatgggcgagaatgcctaggtgtccgcgtggcatttggcacaccgcgcgagatgacacaaagcgattggccactatctccctagcatgcactccctcagggcacgcaattataccggggtatgggctaagtcttcggaacggccctatgctatgaggtctccatagtaatctatgccgccgtttattcgactggggcttcggaatgggtgacgatgcagcgagaaaacaaagaacatgtccgggtcatagacggccccaccatctcacatttcactggttaattgggtctaatacgaaaggtcatgacatcgtgttcggaagcatgggatctgacatgagctgattttgaatcgttttagtgagataaggtgcgcaaggaatcaactccgtgcaaaggctccttgcatcagatgcacagacacaagctttttcttctgccacgccttttgctacacccctccgtcggtcatacggaagtgaagaaccgtaaacccaacaggagcaggtgagtctacttcgctttgtatctaccctacagtcaatcaatgaaaacaaaatcacacgtcgtttgtaaactacaggtttgaggcacgaaactaatgtatctgaattgaaatggttgattaataaaagttctttttttacttatgttttttttaaacaaaaatgaaaaagaaaataggtttgaagcgaaaagtgtactgctctggcctgcgcttatcactcaatgacttcgttgtaaagtcccatgcctgttgcactgctatacaacctatgatagaagagtaaatatacaccaggcaaagaaaattagctttgcgtctcccaggcttatccgatgcatgaagtttgacgatagttcacaatctctgtgtttctactcttgctagcaatatgacttaaatatgaactagaggaacgaataacgaacctcctcacgaacctgccttgcaaattcaagtgcttcctccctgctgttcctggaaaatacattgaagtatgccaagaaactattgcggcccgagctaggatgagcaaccttttgcccacgcttgacaagacatgcagaacggctgatctgctttgcgaggtctggtcgtcgattcttcaaatcaacgcagatatcgtcggagtcaaagattcccttcaaatgggccgagaaatccgccggaatgaaaaccatgatgcatgtgtactgggctccgtgcaggtatggccgcgaaagtgctcgaacgcgagccttgtcgccgacggcaataaggagggccaggccccagtagtcaatgccataagtggactcaatgatctgtgagcctgtcataccaagagggcgcgggttgatctcgattaaccaggctgaaggcttctcaggcgctccgggcgatggatccactggatgcaggtcgagaatcccattgactgatttatagtcggtagttgaattctcgacacggccttctagatgcatgatgccgtctcttagccctagtttaagtagtgtattgaggaagctgtctctgagaagactaatctcttcatcgggcagtttcgatggataaacactattcaactcgtgaaagttggtgacggacccaactgttggcccgttgatgtcggctgacttgggcaaatcatcgcatgcttcaaagaacaagacttccccatcgagcaagacgaagttggcatcaacttcaggcccggagcagtatttctcgatgacgaactcagtgccatggcgggacgtatcgatagctttcacggcagtagtgagggcctcgaaagagtcaacacgagaaacgccttctgagctccaaccgtcgcagggcttgacaatcaggggatatgggagcttatttttcgtcgcaacctctaaagcttcctctaggctcgaagccctaaaagcttcatggccttcatatttgctggtcaaatacttgttggttgctatcctgtacgcctcctgtgacgaggtctgaaggcccaacttctcggcagcttcgcagatgtagatccaaaaagaatctgcaaatgtgattataccatcaacgtgcttcccataggctttgattgactctagaatatgagaagcacagtccgcctcgggaggattcgtcaattttgttggtatgaaggcttcacaccaatgggtatgttccggttcttggagcaagcttcccgcgttatccaaaacaacgagcttgattccaagcttctttgcggcatggtacagtcctgagccagttcccagctccccagcatgcgaaatgttagcatcaactaggacaagagtcttttcctggataagtcccgggagcatccaggggaatgacagtctgttttcaagctctgactccgatgcatgggaaagagcctcgatagcgtcttcattttctgtaacagggctgatccgaagaaggagaccagctgcagctgcggcgaagagcgttggtagatcatagatatcagactctggtactgctaaacccttgtagctctcaagtgggcccgcaaacgagacgaccttttcgacatattcagagtcccagagacgcaaggaaactacatctgatctagctatatgtccctctacaaggggtacgatggccttcgctactcgaacattgccaaggttgtccgtggcatcaagacattccaataagaaatgaaatgcgtcaagagatgcaaaggatgtagatgagagaagggatgtagaaggtttgttcccaacttgcaagacaggtgcgtctacagccacttttctttcgcctttgggcacagaagcaccagtcttcaacttgaagacaatgtctaccgactgccataagcttctagcagactgggattgtcgcactctgcaagaatagtctgcaagtataacgcctactcacacatttatttagcgggattctccgagccaggggtaggatacgcaccatgttcctctcctgagaagagttggagactcttccagttatctgttgcatcagacatgtttacttctttccacgttagtacaaaagtaaatcgagagggtagccttgttcagacgcgaacacatgcagcctttggacatcacctacgtcgaattagcacaaccgcatttccacgtaatttaaccgcgagattgatatacctttttcgttctttttcctaatcggacagagatgcgccaaatactgattcataccagacgtgaaggtatttagcagacccggtgtatacgtatcgcttgtcgtgtaagccggaaccaggtcgccgtttatcagccaatggccaagagcaccccctgtctttgtatcacattggctgcatacacgaaatgccagatttagaatgacaaaaacaaaccagaatgagtagatcggccccacgaccgtctccgaattcaagggcggagtccacgaccaccgaacgccccttgcatccagaacttcggtatgcgccgaacttttgcccgaatcctggagggttggagataagcaaaattggccggtcgtattgccctgcagtttctttgcctggatcgggatcctcatgcatcccctatctagaaatgagaccacgctgactgcctgcttccagctgggtaacctgtgggggcttgctggttgacgctgatgtagctttcattgagccgatatcgaattcacagtattgcgcatagaaactttgggaatggattttatgacatttattagaacaagtggcgttatgaaacctctcgaactaatgtagattctgcatgcccaccatttcatagtactttccgtgttttgccatgagttgctcatggttccccatttctattaccatgccatcttgcagcacacatatagtatgcgcattccgaactgtgcttagtcgatgagctaccatgacagtagtgcggcccttcattattgcgttcatggccgtttgaacgacggcctcggattcagtgtctagtgctgaagttgcttcatcgagcaggagaattttagggcttctgaggaacgcgcgggcaatggaaatacgctgcttctgacctccgctcagcatgctacctcccattcccacgagagttgatagcccatccctgttcactgtcagcaactcaaaacgactacttggggactgaaaaatgacgtacggtagcgactctataaactcggcaatgttggcttgcctacaagcttcgagaatcgcatcgtcactgacctcttcccaagccagaccaatggtgatattctctctgatagtccctgaaaatataatcgtttcttgacttacaagcgcaatatttcgacggtactcgtccacgtctaagctttcaatgatgtgaccgtcaaccatgatgcgtccctgatctggctcataaaaccgctcaagaagcgatatgcatgtactctttccgctcccactctgtcccaccagtgccaacgtttgcccgggttctatggttatgctgaaattatccagtacccgtttgtcaggccttgacggataagagaatccaattttgtcaaacacaatatgacacggttgcgagtcgtgtaaactcggtttcttctcggtaggttcaggtgaagatttagcatgagatttgcctctggactttagcccgatgattccctgcagctcgtgacttgcatgcatcgctttgctagcgtctggagcaaacgtaaatatagagccagcaatctgggaccctgaaacaagacacacgaaacatatgtagacttgaaatgcggtgtactctctatcagcaatcaaaattcctccgtaccagaagccgagtgctgcgcacaaatagacaacggactgtgatgcagcgtacagcgccgaggcagataaaattggtcgcaacgacttggccgctccctctgctaaaaaatcatcatagcgcgccagagcgtgttgttcaagtcccaaagacgcaacagtgcgcatggagcggaccagctctcctgcataagctgcggaatcaacgccgctttgtcggattcgggagtcgaaggttgtcaagacctgtaggcgaagccatccacaagcaactacgacggggatagtggcagtgcacaccaaggccaacttccacccgatggccagtgagacaacaatgccgccgaggatggtcgagatgaacgtcaataggccgccaaggactggcccgcccatgccggagagatcgtccgtgctcttggaaagtatgccggagagcgcactgggggaattccgttgctcgtcaaaatatgccatgtcctgatgtatcatagatccgaagcagagctcgcggatcctgtgtgagagtcgttgggttgcataagcaagggatatttccaatcccatgaacaagatgaatgttccacccgcaagggcgacaaacactccagaccagagattggcttcgcttcttagttccaagtgtcgagatgatggcaaaccaattacggtgagcaatttggcaaagaaaacagattgtctgattgaaagattaagacatgccggatcataaaggggcaaaggtaatccaaaactcacgctggaatagtcaaccctgcaaatattgcacaaatgagtccgaaagtaagtaccttccagtctgttctactcatctttgtcataaataaggcggtactcttggcgctcagagctcctattttcttggatgaggctgtgtgcgttgccaggctgttgccatggcttgattgggtttccttgctgtctggatcatctattgtgatcgaggaggccttttgcttggtatcctcaatcgaatacctaggctcagcctcaatttccgctcgcttcgtgtcactgatttgctgtttttgtaccaagcctgcgtagactccatttttgacaaggagatcaccatggttaccttcttctactactttgccgtcggcaagtacgataatattatcggcattcctgacagttgagagcctatgggcaacaatgatagtagtccgttgttctgaggcaacattcaatgcggcttggacgatggattcagattttgaatccaacgctgatgtcgcttcatccaggagaaggattttcggatccttcacgagtgctcgagcaatagcaatcctctgtctctggccgccggataattgaaagcctttctctccgacctgagtctgatatccttctggtagaccggtcacgaagtcatgtgcgttggccttcttggccgcttcaaaaacctttttctcaatctcatctttggtaagttggcctagagcatcggagataccaaaggtgatgttgtctaaaatcgacccattgaataatacggggttctggtcgaccagagaaacttgccttcgtaaccagcgaagattcaacgactggacatcatgtccatccagggctgttacgtgtcaacgatatgtctaatacgcgattcatgaatgttacttacagacattcccatcagtgggctggtagaaccgttccagcaagcctagaatactacttttcccacttccagacgggccgacaatggctgtcttcttcatcgcagggcatgtcaatgtgacgccgttgagaacagtcacatcatcccgagacggataaaccagctcgacattctccagcctgatctcaccgacaacatccgcaggaacttcgccgatatctaacatggggtcctcgggggattttcttgaaattgccttcagcacttggccggtgatggcaacaccagacgtcagagcttgtgccgaaggagcgattctggtgatcgcaaaagagccgatagtgattgccaatgtggtagcagtcacgccagcaacagagacctcctgctttaccaggtatatggaaccagcccagaaggaaagcgcatagaggaggttgggcatagtattcatccaggcaatcataccatcgacgatgttctcggccgtgctattctgcttgtcggcactgctcagaacggcaaggtatcgcttggagatgacttcctgaattccaaaggccgtgatatgcttgatggcgctgagagcctcctcagcaatgccagaagcctggctatactgctctttggcgagcttgaaatgcttgacagcgtatgcgccgccgatgcttccagaagccagcatggcgacgaaaaaggggctgagaatgagagccgttttccagtacatgatgaacgcaacaacatacgcagcgcagaatgtcgcaatggctgtcagcagcaccgccagcttgctcgtcacggcttcttggatggtccccatgtcagacatgatgcggtttgtaatctcgcctggcccgagaaggtcgaagaaggccagattctggcgcataaccgccgacagatatgcattgcgcagggctcgcgcaaaacgctccccagagaaataatatcccacggtagccacataggtgagaacgaagagtgcgacgctcagatacacgtagtagaggctgaaggtcgatatcttggagcgcagctcgtctgcagtgactgtacctatctcaaatccattgaacgcccctaccaggagaccataaatgacctgagacagcggtaagcttctaaacagagacgcgggaggcatgaagtggaatagagcattctcctaccggaacaagaggattcagcgcaccagcaagaacggcgcagaccgagcttacgaatagaatcactttgtccaaactcgtgagatattggaatacatttacacgcctgtcttctgtggcaagtccgtgcagctggcggtctagaatggcccgtttgcgctcgtcaccgcgagctgcttcctctgctgaagccatttgggatggcttcaggttcactcaaagtgatcgtgattcgcaacagcagcatgcagagaagggggcataatgtctactggctgacaaaaatagccaggtcatggggtgagattccctgtgcacgcgtggttctatcaaaagtactgcccaccgaatcaaggagctgagtcaccctgcatatcgcatgcaccaaccatgggcatttctgcggccgatggccagggttgcccttcgcacctgaattcgggcaaatgatctgcccggtccgtgagtaatatggcctgactgagccaggctttgtttttcgatagattacgtgctcggggcagtgggttttgccgctatccccgtggctaattatgctaattatgcctatctgctgcatggatagtagaatgacgagtgaaaagtaaccgaaaaggtgcctgccggctaaccaagcagcaaaaatgttcagccattcggaggcgagtgagatcggctggtgatggcttcggcccgaacaaccgaccagccatggccggatgggctggaagctctccaagagcattcctgtgaagtaaataacatacgtggaggtctaactagccttgatagcttgcaatgaatagtattgtaagcactccattgagttgagtagtgaatgaagcaacacactggttccaacatggtcaaacacatcgacgtgcttattgtaggagcgggaccatcagggtaggtgcacatgcatagagtgaatgaaaatgttggtactgacttccatgcgtcgacaagtctcactgcggccaactgctttaatggcagcgacctgactgtacgcatcattgataagaagccgggcccggactacgttggcaaagcagatgggatcaagagcatttcgattgaggttctggacagtctaggaatcggagatgccgtgttcagtgaatcccagcgtgtcgaggagattgttctgtggaatcccgatgagaatggcactatcgaacgcacgatgacaattccggaccgagtcgaggagctcatgaagccgcgagaggtatgtctcgaccaaggtaaggttttcagcttcaaagcgtctgaaatataggctaatggttcaaaggaagggtggaaggtttgatggttgaaaacctcaagaagcacgggagcgttcaaatcagctggaacactcaacctgtggacttgaaaattaatacatctcaaaaaaatgatccggaggcgtatcctgttaccatctctcttgaaaacaccaacacgggcatgatcgaaacactcgctgtcaagtacatagtcggtggcgatggcgctcacagttggctacgcaagcagctgggcatcaatctcacaggagatctgacagactcaacctggggtgcgtcgctgtttgcatatcaactctttatattctaggaaggaagctgatattattcaggtgtacttaatatggtgcccaagaccgactttcccgatatccgcaaggtgtttgtcgttcactccgtcaacgggaccgtaatgggtgttcctcgggagtcaaagatggtgcgcttctacatcagcatggacggtgggagcagacacacctctattaacgttaaagatatcacggcggaaaacattatcgaggcggctcagatcatcatggccccatacaaactggaggctgccaggataccctggtggtccgcctactgcgttggccagcgggtagcagataggttctcccatgatgaaagggtgttcctagtaggtgatgcggtacatacgcactcgccaaaggccggccaggggatgaatactagtcttcaagatggatataacattggatggaaattgcggtactgtctagagcagaacgcaagtagagaactcctctccacatatccagtcgaaagaaaaccagtggctcaggcactcattgacttcgatagagcctacctagagacgtttgcccggtccgacatcacacacgaggagtttctcgaggcatatctcgctggccagagattcaccactggaacgcaaatccagtatccggaatcattgattgtgaaaggtagcaacctcgagagcacatcaccactcgctacccaattggtagagggtgttcgtctaccagacttacaaattgtcaatcaatcggacggtgtcccggtaaagctgtaccaccgcctcacctgtgatggccgattccgagtcctcgtttttagcggcaacctgtccaacggggcctccctgtctcgcttcaacagtcttggagactggtttgagaaatatctgccggcgtcctctgggctagagattttgactatccatagctcgaaacgtgaggaggttgaactcatggatctgcatccgagtttccgcccgtggagtgaggatggttgggattattgggctatctatgcagatgatgatagctatcacgatggccacggcagggtgtatgaaagatgtggaattaacaaagaagaaggctgctttatcgtcgtgagaccagatggctacattagtaccattcgcagcttaaaccagactaccgagatactcgcattcttcagcggtctcaaagaaggtaaggcgcaatctgtccaagccacagagagccttcgaacaaggctataatacaatacttaggacaaaagacattgagtaagcacattagactcaaatactacgtgaaaaaacattatagtgaaagaagggcttccataaagtgatgaggtagctatttgagagagcattcttaacctgcagctataataaatcagacttgatacgtaggctgaatggaactatccatagccaaggagaaggcgggggcgaatacgacacgttcttttaagcgtacacgataagttgtcgcaaggcgaaagagacatcctaccgctgttcttaagcaaagtaaagacgtcatatgttgccatacgggaaattggacggttccttcaatgaagcatgaacaatatgcttgaagctataaaaggaaaaccatattgtgttctaggaataatgaagaagtcgtctgacatggaagaaaaagaatacagccatctcatccaagcttcgtacctagttgaaatttataggtcttgtagcggtaggtagagttacctaatgaatcaattggatagcatcttggaatatctattgcttacggcgattagaataaaactcacacaaactacgtccagacgatatattatttgactccagctcataaactcggtcgttgagcttcgtagtcagaggcttgatctttagaccagacagcctgcaagacccaacatatgatatccctagctcaaacccacaagaacacgatcaagacatcgtcgggagcttcaccagcccccctttgaagcatccaacaacgctatgttcgcatctgtatcatgtatcgcacgtggaagaagaactggaggtctagtcgggtgaataatgttggcctagttcctgtagttgagattgaaatagccgcatttatcatggagacaggctcttcgggagtggcgaacgatcggacggacgaataggttaggaacgcatgacaaagctgtccgttgagatagcgaggttgtaactgggctggagatccaacatggcaaaagggacagctacttatgtcaagcaactggatggctccaaccatttatatggagcgtgtggctgacagtcaaaagatgacgcgggtcggctgggcgctccagatcaaaggtggaatacatagatgccagaatgggtagggtaatatatgaggttgatattaacataagtagtctacattactatttgtgatcttcgaaatgtctatggcgacaaattccgtgctgtaatctcgtacgcaccttggcaactcaacattttcatatctaacttctcaataaatgaacattttctaaaaacaaaagttagatgtaaaaatgttgagtagtcaatatacgtccgaggttgcagtacgtgatttgctgccatagaaatttcagagattggtactgcagactcgatatcaacttcatgccaattcaataaggattgttgttattgcttggggagatggctgtggtttgcggtgatgagcttccccttcggagccatgtatattggttgttgaaggctccatgttggatatcgaccgtaatctgcttaaaaaggaactgtgtgatgaagtcacgtgcgtggcctgggatcactcttgattatgtaattagagcaatagcaatctttgcctctcaacaagaaattcgcgccattcctagacttctttggaaagatgttgcgggccgcgctaattggctggtcactgaagctcaagcccctgaagcttaggttagcagctaagactacgcatggtcgttgtgataaaccaacgacaccttgacgcaaagaacacgggttgtgagactggtcatgagcaatgcctagcgctcccagatcaacagcttgtcagacttgcaagcagaaaagaaccaaggtaggtgtttcagggcaccccccgcagtaacacgtcctcatcaccgcttatccatagtgcgataaaaaatggccagcatgcacgcagtgcactcgaaagggtgtcaaatgcccggggccttcgtcccgggtgaagttcgtaagaaatggccaccactctgctcccccttcgcacagccgggccttggccgaaggttccgaatcttccccatcccttcagcggcgagtcatggtcagccaaggcccgttgaagtcatatcgtggtgggaatggggtagaaggtagctttcgtcttcaagttccccgttctaagcttcaaactgccgtggatactattagatctctgttgattagtctcctggacacaaggggaacctcaacttttgggacccttcactttctggagttctgtcctcagaggatgtcacaaagtgcgtgtttgcgggattgcgtagcgctctattgccacgcttggatccagtgccatcactaccgtcaacccgtttcggaggtgcttgaaagcaaaatttacggtgtcgcaatccggagtttgcgaaaaacaatgaacgatgataaactgtacacggctgagacgctcggcgcaatggttctgctggaacgattcatgtacccttgcagactctctaagccgaaagaagtagtacgtcaccaactcggaatccggcatgtgatgaagcaaattggccctccaaatccagatgacgacctgcacagctggctggttcggggatcagtcaatacgatggtgagttctacgcatccttctctaccttcgttgactaacccgtatcgcagtatcatgtcgccaagtatggctttagtgaagattccacagaacccgaagccgatacgcccagcagcgaggcaactggaacatccccgtattggggtgatggcagccactgggatatgaaaacagaagaagatgatcatgattatgatgatgagctcgcgacacatgacgacgacgacgatgttgaggccattggcgatgtcaaacaacaagatatgttcattaacagagggaaagctcttgtcttgcagatcgctttccgtcacaccaagagctggctgcccaagataagcgaactgcgacagaatccttgtaatgcggagcggcagaaggccgccctcacccaaaacatagagaagctggaaatggctctcggcaatgtattgaataaagcctggaagtcgtgtttggcttcaggatccattatcgagagcctggatcccagcttcttcctcggccgccgggtcgactttgtatccttgaagctagcggaggatctattgagcatgcttctctgccatgccatgaccgtacgtatgcttggtgtcttaggagacatcaatgggaatgcggatgagtcactcttgagcaagtacaaaaccatatgccacctctgctggttgtgctttccgtatttatgtaccgtcgacgccgttttccaagcgagcatgttcaataagctcatggtgacactcgagcctgcgactttggaagagcttggtcatttcctcgccctagatatggactgggcgtcatgtggcgtaaaggacccgaaggacgtcaagtcgttcttcttttgggttcatggcatggtgacgttcttcacgggccaatcaaactgtacaacgggatattgacacgatagacggacaccacagaactatcaacccgagatatttggtatcacatgaatccgatgctttgatttattgcgccgtcatttcgaaatatagaatttcgctctgtaggactgggttcaaagccaagcctcctttcgcatctgcaataaacagcaacctcatcttcacactcgcaaatttccgcaaatttctatcccacggccactaggtacacaccaatggcttgtctggctacaacccaattcatcaggcagtagagtcttagaataaaatatctggttatctggccagctatcaagagggatcaatgatgccgcgggccgaggcatattgccggcatgtggatagctggtattgttaaactgctgcatgaagcggaatgagtcgagaagatatgcaggctcgttatgtttgttgttctcaaggtggccaacggtagaatggagcgaaggcaaatcttgggttgtttccccagacccattgcttctgcatcatcacctccattcaacgacgtaggaggggcatttccacttctcaagttgggttagcaatccgaattatggctaccggtgcttggctggtaaagcagacgtgaggctaagtgagagtgtggactcgatttgaggagagaatctcaacttaatgagcggctagcactgaagtttgaggctacgtggcttgcattcggataaggagatggaactgaggatgccaggatttcatgacaagctgggtggcgaggcagataaatttacggattaggaagcgctgaggcattcgaccaaagttcaaatgcagaatcaaattatgaggaattgatttaacaacggtactataaattgatgtatattgttattatatgtttgactgcttcttctcacaccgtaaaggggtataaaacacagttaccaatgactttggttgttggcaatgtctaaagtgatccttcaacttatcatcaattgagaaaaccttcatcaactaatctgatcatcatatcaagctgtaccttaggaagagggatatgggacagttccaacttagcactcccttgtcttagaagaaatgggagtcgtgttgatgcaagccccgccacatggccttccctgtctacatgtcatcgtaggggtgcaggtaccctttggctggcacggtcgattgtgcccaacgatacatcgagtgacgggtattgaggtcggtgttgcgatacacgctccgccgcaaggcgaattggtagtgcaaaccatagtcggtgtgcaggtgcttccacttgaacagggagaattatcgccaatggtgcactctgtaggggcggcatacgtggaaatacattggccaccccaagggaggccagaagttgagtattcagtcggcgtacatatgctgcccgttgggcaaggggcgtcgttgcccacggtgcaagggatgacgggtgggtagcttggagggtcaatgcaaaggcctccgcaggctgtgctggtttggcagatctctgttggagtacagaaccacgaggtcgggcaaggggagtcgtctcccatggtacatggcactgtgtatttgggagggggtggcgtggtcgttgcgaagctagtggtgaccggagggctagcgacggccatcgaggcgagcacgcctaggatcgcaacgagtggatacatggtgtatagtaaagctaatagaaataaaattcgggggcttgattctgacttccgcggagtaatgtgtaaatcaaatcgagtggcgattgcctttcgtgaagttgcaactacgggacggaggctcttttatcaacgacaaaaccggcccgtcggcttacaacaactcacaactgcggttgtcggtgtaggtggaaaggtgtcccaggataatagccctgtagtcggcacagcgaatgatgtgggaagaaattctcgtattgctctgaacccgtgacgtttgtggctgggctgaacagcagctgaaagtgaccaacctatcagatcacaattcactttgcatggcgtccgcctgcatttcgtattcaccgcacatacttgatttttcccttctcgctttcatcgcattcgcgacagtggcaatgagtgatttccagcattactggtaaagcacagataaaaatccatcactctcgaaacaccacctcgaggttgtttgtccttgatacctagcaataatggccatgtctcctgagcctactgggctaggcttgcctttcaacacttccgtcagcgttatctatcgactatccccgcacacacagtcttgatgccaagtccatccagctattcctatcaaggacaagcctggctcgtggatgtggtgagtggaatttacgatctgacctgcctagctataagctaaagatcaatatgaaaaaaccactttcacaatatgagtacgtcaccccatgtctactttgtacaatagatgaaagaatcaaataacaggaggctttggaggagcaaaattgcacaaaccggttgacaaatcaaaactgcacagcacccaaaacagcaataatttgtgtacctaccgtgaatgatggctattttggatatggcgttggatttcaaacctgcatacgtcgttgtagaccggaccaagtgataccgcaaattggccatagcattatttgcgagtatctcgaatatcttgaggtcctcagcttgatgtgggcgaaaaacaaacccgtagagtattttttggacctcatcataaagacacagaagtatatccgcttgcggaccagacaaggcaatgagagaaagcttgtagacatcgcgttgatcaggacaggcagaggcgtcagtcacaagacagataaatattatgagtagcgacgaaaaaatggaagtttggaacaggatttataaccccactgtctcacagcgttacagcatgatggctgcccgatagcggacgagtcgatcccggccccgcttggacgtcgagtattaatagatgctgacactgggatccgtacgacttgggttgttaagaaaacagcatttaagaagctggctactaccttggagaatcgtgcctaagaaggcggttatcaaggaagcggcctttcaaaggcttgtcccaggacagggcgcgaaaagaaatggtgagtagagtttgtaaatattcctcgacttaaataatgagcgagtcttagatacagactgtctatgggaaagtcggatatcattttcttaaaacaatgcttgaaatagctgtaagacatggaagagggtaggctacagctatatttacacagcttggtgcatcacctctattcgcagagatatggaggtaaaagtagacaattaggagtctacaaaaagagacaaaagcctttcacacaaaccgtgcatggcatccctgatttcaccagtgtatggtcgtatgcgaggttctggcgatatatagatcgtcaaggagaaccggagacgaatctacttcaggggaaaggttcgtggtgtgatccgttccgagatcaacttcagccctgtctatatttgggaacccatgattgtgaacctactaacgtgggcatattgaaaaattagacatttccctgtgttgttcactcaaatgctggtagtattgcctcacaaaactttccctagatcggaggggaaacgatcctacatgacactaagaagaccaccgaataccacatttaggctgtttttaagctttaatgaagggtcagaaatttcgaaatcgaatgagttaacatgttattttgcagataacaagcattgaaacaggatagctaatatcagtcaaacttgtccggccagcccctctgagcgtgaaaaagatccttatcaatggtgagctcatgtccttaaatccttatagcgccctgtaaatttcgaactgattctggaataccaggacgtgacgtgcgaaagactccgccgcattgagccggcaaaggctcttccgtggcaaaccttatctgcctatacgatgtttgaatagaattcgatggaaagttccggacaaatatgttgaaaagaaaaactctaatacttatgatttggcccggcaccgaaagccgtattataaagccgggaaattgcccctgtccgagagtaaaaataaggtctgctcagccaactctctcatcgctcaagtctggagtcgtgaatgcaatcccgatattgttgcacaaaactcaaagacgagcaccaattcaaataatccatcattcgatcatgggcctacttaaaaggtcatcaaaaggtgtcaaagatcccccccccatacactcctcgtcaggagattcagtcatccacctcatggaccgatgaagaaatagggcaaagtcccagtatccctgtgataagtcacgcaggtgccatgacaaaccggttgagatcgctggttgaaaagtccaggccgggccaaggcgctggcccgagagattccttttgtccgccaaacacatggagagcacacaggtcaatcgaattgggctcctgcaaatgctctgttgaaatcatgtctatggaccctctgatggccgctgcatctcacaacttaacctgcagccgcctctgtcagcttccagaaaagatcctcatcggcatcatgaagcttcttggccctcttgacatgcaatgcctgaggcgggcatgtcggcttttcctacgtctgtactgcgattttagcttcgcggatagtcatgacgtacagaacttctggcattggatgtcgctatacgaacattggctaagtcctgacaggtcgtactggcctaaactatctagtcctacactcatttctcgcctcgagagagatgttcaaggtctgtgtactatctgccgctctatgcgggcgaaatcagactggacctctagggttaagaaactgagcacggagtctctctactgctggggttgtaagaaacatcacccattagccctcttctctctaggggagcgacaaaagaaagatggccgtgtctgcattggaagacagggacatattcgtctgtgcgatcataaaatggtgacttgggagatggtgtcgaaggccgctaaacagctgattaatgttggtggtaatttcaaggctagaatccagcttagccgctgtgatcacactgaccaccatcctaagcatcacaaccttgctatggcacttcagtgtcgcaacgtttcgccatctgccgagatacgtggagtcgaggggcacagcctaatattgagcttgacttggcaaggtcacatgctcgtagagggagacgcaccgatcaaacctgaagtgctgtgcaaacagttaggacaattccgcaagggagtagcacaattcatcgcgcccaggctgcccccgggacggttgccagaaatgagctgtttcgacccaaaccgctgcgactgtctttactttgagggcatggatcaattaccagactggccccgaccgttgcccagtgatctcaagatagatagctgtcgaactcatccggagttgagactgacagcacttcgaaacgcggctggtgattctaaaagttggccagatgggcacatgaattcggtgccgtttatagccaactatgagtatggagcatccgagttgcggatgttcgttgagccttgcgtgaccggagacaaacgatgcctggagattcgctatgtgcgtgatattggattgtgttatggtactgacaagcggcctgaatggctagatcacgtcacgtcagcatggtgccaagctctggagcctgaactggacaccgaagatcttcaagccattggcattaattggtgtcctacacggggctgcatgaactactacaagtatctaagaatggctgtggctcctgttaaccgagccaatcgatagcggtatccaaatccatcaattacacagttattacctggagacaacctcactcgccattatacctgcaagctgagactacaacctaatggccacaaagtacctgcagcagatgtggttcctgttaatgacattgaacggctatgacgcggaagcaggtggaactggagatctgagattaacgtcagcgcaacacggggaccaacagtgtagtgactagtctaaactaaaaggaaatcggtcaacatgctcttacggaagcaacatcttagagaaattgttaggtagacagacagcgccgtgcgagcaatgtaagaaccataatttcatgctgctgcttcgtccaagagtacagttcattagacgtttaaagagggtcaacattagacgacaagccagagtatcctacaatcgttgagtcggtttgcatgtcttgccacaactctctgatagcttgaccaccttcaaagacgaaaggcacaataaaaagaggcgaagaactaaaagacaaaatgaaaaacatataacagcaggtattcgctggttgtcaccgacccaactactaatccgcccctcagatacttgactataggagagcagacgagatctcttatcagactatcctttcttcctgattcagttatatcttaaccgatatttaactagcgctctattctatattcctagccctatactactagctgcatctgttttattatatagaaatagtaaaataatactatagtactagtaataagagatatccttaattaagctatactataccttaccttaagcagtatcctctagaaatcctcgctttattatataataatacctctattagaaattactaaggggaagtaggaattaaatagtacttctattcctattattctctagcctcctctatagatagttataccctttatattatcctagtcttattaattatttactataatagttaagtttaattttaataaagtaaaagcttagtaagctatttttagtataaagaatatattaaaaatcctaaagaagagctagatatagtaggaaaagatctggaaagtataggaaatatatagtattagtatttacttattatccttagctatctactaatagtaagtttattaagctttttaatcaggctctaagatatatttaataaggactagatctagtttaatcttctaaattataataaagttataatattatagatctgaactttccttaaataattctttaagaataataagaagaaaatcctaactattagatctaaagaaaataaaactatactttaaatttaattagatagtatatactaagagtactagtatatactaattaatatagttaataaaaagtatatatagctttagtaaaaagtaaatagttaagatattaatactaactactaggatctataatataatcctattaatccgggcttaaaattaaagctagtctattaaattactaagataagtattagaataaactctagtaaattactatatctaatataataatagtagctattaaacctagtacttaagcttaaaggctttcttaagtagatatttataaagtagaaggtaactattaaagatcttatagaaataatttctactctttagacttaattattagatattatttattagtctagatactagattaatttctatctagtggtcttagttaggagtattagtagatagtaatcctaagaggttctatagattaagtataagaatatagaaatcagctagctttagaatctagagaatcccttaaaaccctttattatttataatattataatatactatattaagataggccagaagatttatatagactagatagaagtatatataattaatatttactctagcttactctctctattattctactaggtctttatttatcttataataacttaaggctaatatataagtttttcttattagttttactttctagctagtatagatatctaattcctattattatactcttattaaaatagtaattcagactcttaataataatacttttaaaaaagattataaatctattaactagattataaattaagcctaggaatataatctaagagtttattttatttctatatactagaaggtaagtattctaaagtaaggaatctataatataaagtataataattttctaaggatatagaaatatattatatatattataggtttagatatagagaattaactaaaactatatatctcttaggtagagatagagggttacttactagataagttatataaatagttttatctagtaaattaaatcttataatatttactctaggagctctataatctataataagtaattatatcctggggtactctactaagatatataagagaaactattagccttatactatccctaacctctaagggatagcttttagataataggtagatagtactataaagattctagcccttataaagatagcttttcttaggaaggataaaagagtactaatttatattatagttaaaaaatagtaagagctaaaagagtataataatattaagatattaagagcctagctttatctattactactaggactagaaaggaaaagaatttttaataagattacttagataaaaaaaaagttagagaataacctttaagaaaaatcttataaagaatactttaagaaagccagggtactataggagaaaggtcttactatagattacctatataattataaggtaaaggattcttataagtaaaaatactaggcttttaataatagtatattcctaatagaatagcttcttatttaagacttaagcttactagagatctatatttaaatactatattacttagaggaataaaacttagatagtctagtagattaactagaaagataaactaaaaagctaaagtatttacttaggtatagggtttttactaataaggatatactaatatactatttagagagctattaatataataatagtttttagaaactatttatatatctggaatataagatatatatttctactaggagagagttctagtatagttatattatatattactataataagatctatatactatctactagtagaaaggcagtttgctttctctataataagttctttaccttatataggtttaataattatattaatatttatattagagatagctagtttcttaagcccttcctatactctaaatactaatagtatcagaaggttaattatataatataaagcttaaataactaggaggagtatagatagatatataactcttagatattaataaataagtatatatagatttactactcttaaatcttaatatctaggaagagaccctgttggattttatatagtagattagacaggattatattattatattcagttaagttatatatctccggtgcttccggaggaattaattatataaattactatatacttctcctttaagcctaatactcttctaatttaagaaagaaggtatatttatattaaaccagccttaatataactaagtatattatattatataatactatagttctaatatattctctcagaccaggcttatatattaaattaaatatagatatctagtctatagtattaaattaaatatagctattaaatagaagtttaaaataagtaatttaagattaggtttaaatagataaagcttatactattaagataatagttagatttattattattattattatctttatagttatatatatataaatagagctnnnnnnnnnnnnnnnnnnnnnnnnnnnnnnnnnnnnnnnnnnnnnnnnnntattatctttatagttatatatatataaatagagctgtaaattatagtattactttataaattatattattcttatatagttatctttttatttttgtcttttaaagtatatttctaattttatatatttcctttattttatttaatagtatatttaattaatactcctattattatatagtttaaataggcttataattataaaagtaagctataaggtaagaacttctattaaatatagcttttaatatatattatataggggaaagtataaaatagctcttaaataaatattcttattataattttataaaaagcttctctttttcctcttttctttagctatttataaatttataagtatttagttagtataattttttatattataatttctttagtatttagtagttagctaatattataatagaaattatttatttaatctctctctctctctcttataaatagtaagtttattcttattcttatttatatagttcctttagttattttagataaaagctaatagttataatagttaaattaaatttactatatctagtatctccttccccctaagtaaataaatttaagattagaattagtagttttaattactaattaggtattagtactcctaagatctatatagctactactactagagctaagaaaaagaagaaatagaaggagattaagaagaagtataaagaaacttataagtactacctctaagaggaggaggagtataaggctacctgccttatcctctagaagtaagtttactccttagtttattactttaagctttagttaactattttatagtactccgggactatagatagtcccttataagggttatttatacttagcccttataggccttttaagcagatagtactagaactatctctctaaggaggggagccctcttaagggctattataagtagtatttagtaggtagcttctataagctaatataaatctccttttctttatttaatacttattttatagctaatattagtatttatagctctaagagtactattctaatagtattcttcttcttagattatatctaagaaactaagcagctagttcttctagctaataaccttataagtatctttattctttagttttaaagcttatatactaatattaagaatagttatagtctaagtactataaagaggaagagaagtattatattataactaaggtagttttatatagatactatactagtatatttccctctattagaaatacttatctttattaaataagtttagtttaattattttagtagatcttttagctcttaaagagtttatttttctattttatttatttagaccttttagctctaagattaagttactccctcctaatactaatagcctaataggtttaaattaaagtttattttattttactacttctaatatttatatatataaaatatctcttattattatagttctataagaatatcttctattagggtttccttaagtttatctcttcttttcttatagatcttttctttaatcttaattaatctaagttatctatagctttcttagaactaagctccttagagagattttattaaactatctataattaattttaagctttatttataagaaatataaatagtttccttttaaatatattcttttaactaatagttatagatatctatatattttaactttatttttaattttttaaatagctattagagtatactaattatctactagttattatagataaaatataaattaagcttcttaagcttaatttctagttctaagattagtctttattagaataacccttccttagctatctatactaataatagtaatttagcttctgttattaatattataactatattttacttattagcttactatctaataaagctactaaacagctttattatataggcttataaactcttataatctaatatattattagtaaataagatattactataaactttaaacttatttccttctttaaactatagagctagataataagtagtatttagataatttaaaacttagttagctactttataatattattagctaggattaactataaatctagctagctaggagattataaaagctatatctagtcttaagattactatagtatatagaattaatctaactacttacttatattaattagctgttttaagagttatagttatattactagggaggagtttagttttacttataggtattatattcttataattcaaggtatataagctatatattttctctagatatatagtttatattatctataagtataataagctatagttttagataatctctatcctaaggaactattaaagcttatttctactagttaatctatatctctattttagggctttaattatagcttttatagcagcttccttgctctttttatatctaataataatattatctatatagaagaataagagaattcctaacttaatatagtagtatagcttataagggattagcttaaagtttaggttttataatattaatctaagctctatttactataaaagagatataatctataggctataaagtattttttttagtaataagatatataattacttattatatttcctataattagatagtatttatataaatatattatctagtaaatcagtatttataaatatatttactatattaaactatagtattttaaaattaaatcttatagctattactaagagggtttaaaataacttacctgctagtattacagtataggtttctttagtaatagccttctactattagtcttcttaaataataagcctggctttatacttttaaagatatctatacttattaaacttataagtatatctctatatacagtctaggatttataagtctcagacttataaattaaatcttaaaattttaatctaagtttttatttatctatagctctctaaataattaattttagtttatttaaactctctcttaaacttatatccttttagatctcttagcttattaggggtagctagtagctactttctataataagcttaacctaggggaataagggggttttaaaaggtttaaaccttaatctttagttttaatttactatatataaatctattatatatagccttagtttaaaccttattatagctttttactaagggtatactcagagatataatataaaaggcttagttaagttctattaataagttctcagagggtttaaagctttatagctagctttctaatttaattaagtttattaggagagttatagccagggtcttaggtagtattagaaaaggtataaagcaatatataaggtatttataatcttctataagctcttcctcttcctatagttctctactagtattcagattattaattagttatttaaagcttatttcttctattttaagcttatttttttattaggttaactctattacttaattaatctattaagattaaaatattaactagagcctcttttaaatttcctctagagtttactccctaatagtttcctatatttagatcttatttaaattaaatacttcttttttattaaagataatatccctagtaatatatatactattagtaactagattctaaacttaaaagatattttaggagttatatctaactagatagtttatctagatctttagatctaactaagacttaagtctttaagtttttaattatactatcttatttattataaatactttatagctaattatttttaagtaggaaactcttagttaaatctcagtttttatatttatagttagtattattaaaaagaagctctagtatagtattttctatttaagctttacctttaagatttagtttaagagatatatagttattcttactaattcagactatagctatttagataaattactattaattattaaaagctttattttctcttttattacccccctagaatacttactagagctattctattattagatataagaaatatattcctctactttaattatcttattatataagaaaatatagataaaagaactcttttaaagcttattatctatttctaaatatctaatagttattttatatctagttttaaatatccggattaggtatattagtatttagagaatactttactccttctgatccttaaagtaataattccagataaagttagattttctatctattataattatatataaattatagcttctaattcccttttagaagttatagaagttaattaataagtattctcctggatttaaacttctttcttatagtttataactctcttactactttatctttactaggctatatatattatatttaatagttattaagctaattatttatactctatttattaagattactaagtatttaaataatcttagccccgggtactctagctattaatactagtaaattaaattatctttatttagacccttcctttaaatattatattaagatcggaatagggtaaatatagctccttttagtatttcagagttatatttaataatatactaattataataatactccagcttatagagtattaatctattctaatatttaattaaatcctaattattcttttagttctactaatagccttattactataattttaatagtaatactaagttaatatctattaccagatagtaagctacttatttaaagtataaataatatagcttattctatttatttcagacttatataattactttactatatcctaagattagaaagcttatagaatctataaaaacctccttattcttagtaatttatttaaaattcctaaatcttattatattattaaataaatataatatagtttctaaattaagaagtactaagtatcttagtagatagctattattcttaataagaaaggtaactatataacttaatatatagttttagtttactaattattagtactactcttccttttcttaaataagcttattatagagcttctaagccttagggatctcttctaagtattttatctatttattagattagggttttcccttattaaggttagaaggtagattttcagggaataatagctagtaatctcttatattagtacccttatatttcttactatataggatatattcagacctattatctctagaggtctttaactacttatttttatatttagtagtttccccttttatttagtacttttacttcttatctagagggttttctccttaatatattaatctaaagttatcttttataatataaggtttagatagcttatttaagccttctttaataaattataatttagtttaaatcttttctctgaaggtatttataaactcagctatataatatttattattctttatctatatcttatttttacttttctctatttagagtagctttttaaatcttatattcagatacttcttaaggttattaaactacttatttaaattaagagaagttaagacccttctgatctatataaggtttattacctactcctagttattaattcaggctttctaattagttttaggtttcttagcctatttaagcactttataatatactttctgagtataattcttcctttaaaggttatttactctatatatagcttataagttcttaaagaataagtagaagttattattattccctttattagttcctactagagagtagatttatatataataagagctgatatatttattaatctaattagatatattatataatatatcagcctccctattaaattcagtaagtaaagtataataagtagtttatttaaactttatatcttccttatctttattaagaagctttatatatatctttacagattattcttctcttataaagcttattttactaactttatctatataggggaccttagctttatattatataacttccagctttataggtttatagtatctatagatcttaaatttatctatattatttaattatattagatataaaacccttttagaggatatatttaatattaatacttatttaaaggaattctagttatgtagtttattcagcttaatagttatcttaagtaatatataattaatctatccgctctttagttaagctgaatatactttatattactagtttagtatttatctttatagttataattaccttaaagaagtataactctaagactcttaattattagattttatatagtagattaagcaggattatattattatattcagttgagttatatatctctagtacttccagaggaattaattatataaattactatatatttctcctttaagcctaatactcttctaatttaagaaaggaggtatatttatattaaaccggccttaatataactaagtatattatattatataatactgcagttctaacagaccccctattaataacttatctaactctttctttagggggatactaattaaaaagctaaagaaagagaactattaatataataagatatccttagaggaggattctgataagagtatactagtgctctttaaaaataataaattttttataataggaagagataaagactataataattttaagtttctatagctttataatagagtaataatttatattattaggaatagaaaaaacctataattaccctttttattatatatttataactactctttttattactaattaaatatagttagataagaactatagaatactatctgatttattatttaagtactaagtatatatctaactatagatctataactagctaataattagaataaagtagatctatattctctattaatagtagcttaaggagtatattcccccttctaatatctatattcctatttatttcttctactatctttctcctctactctttccccttaattaaaaatcaaactattactttaatatagatattaataatatatattataattctacccctggggatattataatagatatctatctagtaataatattagaggtattacctttacccttatatatattataggctcttgtacagatagtactatatagtattaaagcttctaatataggttagctatctatatagattaaatctggtctttattaacttatttatacaggggagctagtattagttaatatacctaatagtatagtatttctaaaaaagcctaagcctaaatagtaagtttctagaaaagtaaaataaaaaatagctactaagcctttagatagtatatataatatttctagactttagaggttattctgagtattatctaatagaatagtagagattagtatatattaggaatagttctatattagagagttagagatatccctagtactataaatagaagtagagaaactagtttatagttactatactttaggatagtataaagttagattaattagtaatattctatacctactagatactatctctaataaatagttctttaatcttttacctacttatctaaaagtaattccagttataacttaatagattatagcctcttattatagtatattatagcttaataaagcttaaagatattaggatctagtatactctatagaataataagtttaacctcttcttcttttaagatcttctctattctatactagtaataccccggaagttatttaaagatagatatagatatattaataagctgcttactagagtttaatagaatatcctaagcttctaaagtataagagcccttagttaaattcccttccctattataactagagtatagtaataaatagttataaaggtatcttattatactatctactaatttattatttaatagagtactagagtaatacttataggtaaatagataagtattctctgtatttataagggtactttttgttgaatttgagagattatagccactataagttagtgggttcagattgctgttagcgatcacaaccactagcctctagcgattgcagccactggccacaatcgctaataaccccctgctaacgctagccaatagcgattgagatcgctatctgatagcgattacgatcactaaccaatagcggctgcagccactgtgggtcagtggctacagcccgctatnnncgctacggcttagcgtgccctaggaaccctcaggggtccgggccaccagcagagctattattaggttatcgggcttatctagcccagataagggcgcccttttcatatgttgttcaacattgtactccatatcaaaccaagcattagaatcgtttgagttcgcatatagaacagtgattttcgaatgagatggcatctttccgattctgtgagagactccacaattgccttgtcgctgagttaactcagacagacacacatgctaatttcttgatgaaaggcatacctgcaagtggaggagggagagattttgcgtatttggttgcaaagggtttcgaacagtcggtagttgttaattgtgataaaatcaatatgcgggatattgagattgcttatatcttatgatagcctctaaatctctcttcagcaggtttgctgatactagtaacaacgaatattacacgcatttagtgaattctctaaatgcctatatttgtgagtaataccggtatgacaaactttacaagattcgtgaagttttgaaaactgctactccttcctagcttcttgaaatatgaacttgtgattcgctataaaaccgcaaggcaactactatatctacctctaggttcgtgtgtttatgattagtctattgcgatcgtaacaatttgtccagtggcgtcagtatgtagttcgccttcttttcctggttagaaatgagagggcacaatggattagtatgattcagcgttacttctgagttacggaaaggtcacattcctattgatcccaagtgcgagtgtgctcttaagcgagtcatctaataataaattgtccatgattggtgcaaagcagtgagtggtcccgttgcctattatttcagccttgggtgtatatcatcttaccccgtccccacttatcgccgatactgactagggttcattagggtgttttaggtctgctgaccgtgggtcagtctaatttaaccatcgtacggcttatggaaactttttgtgctcaacagtcggtttcctttgcctacttgttttcaagcctctgcagtatggcgacggatcctatcttgaaaaggcatcgagcgggactctcctgtaccaggtgtcatcgccgaaagaagaaagtttgttttgctccactcagacagtatgtcgtctgatgatgctagcgaaaactaatgggttgcttccttcgtagtgcaaccgtgtgctaccgtgcaacaactgttcacgccagggcgtagagtgtatatactctcactttacagaaaatgtgctattagaagatgacaaatagttcgtttaatccttctccgctactctgaagctcgtgttcacaattattcatagctcctccttgccggaccttcggtaagcactactgggtggcgtggcactgcctcaaacaaggcgaagccggctcttgtaagccgaagtaaaacaccaaaaaatgatgatcatgacgtaaaaaggccactttttcggcatcattttggatcgagagtagaaaatatagcaaaatacaaaaaacgctaaaaatcatctaatgtcttaagtaagtcaagttattgggtagggggtcctgcttgacttacttggcttgacagacccctcaacttgacttgcttgagtgccagtaagcccaaacttactcaagtcaacttgacttgacggcagcgctgaggagagcagtaatattaaactttagaattctaaggtttattgaaagctgttcctggtttctagctagtagacctggaagagagtaacacagagtacaaaaaacacgtattagagctaaacaagctagtggtgctaactacgcaagcctagcactaattaagaagtgtttacttgccatagcagacggcatttttgcccttgcaagcaccacagctcatggttccaggaagcccaccgccgacattgttaaccttgccgcccttttcatatgttgttcaacattgtactccatatcaaaccaagcattagaatcgtttgagttcgcatatagaacagtgattttcgaatgagatggcatctttccgattctgtgagagactccacaattgccttgtcgctgagttaactcagacagacacacatgctaatttcttgatgaaaggcatacctgcaagtggaggagggagagattttgcgtatttggttgcaaagggtttcgaacagtcggtagttgttaattgtgataaaatcaatatgcgggatattgagattgcttatatcttatgatagcctctaaatctctcttcagcaggtttgctgatactagtaacaacgaatattacacgcatttagtgaattctctaaatgcctatatttgtgagtaataccggtatgacaaactttacaagattcgtgaagttttgaaaactgctactccttcctagcttcttgaaatatgaacttgtgattcgctataaaaccgcaaggcaactactgtatctacctctaggttcgtgtgtttatgcttagtctattgcgctcgtaacaatttgtccagtggcgtcagtatgttgttcgccttcttttcctggttagaactgagagggccttgcgatcatggtacaatggattagtatgattcagcgttacttctgagttacgaagaggtcacattcctattggtcccaagtgcgagtgtatgttttaagctagtcatctaataataaattgtccatgattggcgcaaagcagtgagtggtcccgttgcccattatttcagccctgggtgtatatcatcttaccccgtccccacttatcgccgacactgaccagggttcattagcgtgttttgggtctgctgaccgtgggtcagtctaatttaaccatcgtacggcttttggaaactttttgtgctcaacagtcggtttcctttgcctacttgttttcaagcctctgcagtatggcgacggatcctatcttgaaaaggcatcgagcgggactctcctgtaccaggtgtcatcgccgaaagaagaaagtttgttttgctccactcagacagtatgtcgtctgatgatgctggcgaaaactaatgggttgcttccttcgtagtgcaaccgtgtgctgccgtgcaacaactgttcacgccagggcgtagagtgtatatactctcactttacaggaaatgtgctatcagaagatgacaaatagttcgtttaatccttcttcgctactctgaagctcgtgttcactgttattcatagctcctccttgccggacctttggcaagcactgctgggtggcgtggcactgcctcaaacaaggcgaagccggctcgtgtaagccgaagtaaaacaccaaaaaatgacgaacatgacgtaaaaaggccactttttgggcttcattttggatcgagagtagaaaatatagcaaaatacaaaaaacgctaaaaattatctgatgtctcaagtcaagtcattaggggggtcctacttgacttacttagcttgacagacccctcaacttgacttacttgagtgccagcaagcccaaacttactcaagtcaacttgacttgacggcagcgctgaggagagcagtaatattaaactttagaattccaaggtttattgaaagctgttcctggtttctagctagtagacctggaagatagtaacacagagtacaaaaaacacgtattagagctaaacaagacagtggtgctaaccacgcaagcccagcactaattaagaagtgtttacttgccgtagcagacggcatttttgcccttgcaagcaccacagctcatggttccaggaagcccaccgccgacattgttaaccttgcagacgccattgacacagataccacgagcaccagtctatatttcgaaggatgttttagcgtaatttatgaatacggtttgagctaagagtcaacttacgcaaccagcacgggcctggaggacggtggcacgcttgtagtaagaagcgtacgcgtcggcataggcatcggcatatggagcaaagctcgtcacaacctgtcgccgcaatacctcgccagtttgcagaagcagcttaccggtcttgtgcagtcctatctgtgtcaggatgccaacttcactgatgcccatacgaaccagcaatggctgaagagcattatctggcaacttgtaaacggtgccgttagcggtgggaacgacgattctatgtcctaccagtattccggcaatatgtctcgggatctgctgatgagcatggcctctcaattccctaatcatggcatggagctgctaaactcaggactggtatgtagcccgcgctgatcactcaaatctttcacaacacaacgtttactaactattacctagattgagaagctgttggaagtgacacactctactattaagtttctctcacttcagcctgcttctcgtaaccccttcgccgttggtcctcgtgagcaggcgaaccagctcctaagcatcgtcgctatgtcgcgcaacggtaaccactgcttccttcccgttcttttgaacaaggcacacgatattctaccccgacttgtcagcccaatgctccagaacccccccgagaacccgaacatggccaacgttgatatttttgatggttttggtaatgccgggatggctcaacctccacagctccagctcgccatagatagcgattatgatcgtaagttccccgttgaggaatatgacaagaagtacgcgatagacttatatattgggagtatggatggggttgatttgtccgggttttacatagcataaggctaggagttcgctacctttgcctttctagttgggtgggcgttttaagggaagttttggctgtcgttgagttgacaatgggtcccgtctacttgaggtgggctaactattgagaataagagtttagaacatagcaagtataaacagaaacagaatcttgcatttatctatattaccttgccattgcctgcgctgcggtgaaacaagtttagatattcaacccttgacaatggatggggtgaaatgtgagcagctgacgccaaagcctgcattgaaacaatcgatgctccctggtctcaatgggattgactttcggagcattctagcgatgcgtcggactcaaacctaactgcaagcttatacattgggtcttgcatgggatgtgagacggatgatacactcctcattgcaactatcatcactcctttgcatcatatgcgaaagagaagagaaacaaaatgaaaaagcataaccacatcacaacggtccaaacctaaacaatcttttccaaaaaggtctgtctttcctcaacgattataggttagcgctaacaacggcttaaaaaataaataaacaacacgtcaagaaaccacaacgactacaacgtgtcttccgatccagaggtgaacaagcccaccggtctccgccgggagttgctccagtatcgccgagctaagcagacctccctcgctcggcctttattccttctcgagctcgattcgcttcgctgatccccctcgccaaatgccagaaatcagcccgccgccgttagtgctactttgtggccctggtcactatgacgttcgtaggctatctggcctaccgatctttggaaccgaggattaacaacacttctaggataggcttagcggatctcacataactgggaccccaccttccgaagtcactcagtacgctatgacgcttgtacgaggcaggagagactggcagattgtgtgcaaagtccgtatagcacgactattcttacgctcatgatacccaacgtgtaggcgcagagactcttcactttgatgtgttcgggactgtgcaggcgtggagggcgacatgtaccttgccacgacatggtactatttgcacgactctgacggcaaaacctaggttaactctcgttgaatgagctctcgaactactaactatacctgatttggtatagcggcgtttcttccacgagaaagtaaattctgtcgtcccagtctcttgccacaatattgtcgcatatcttcttgccatcatatcttcatttcctcctcagccacccctgtcgcctctcccccgctaacagtcgttcttcgagggcgtcatcgattaggaataggcgaacgtaccaacgaatggccgtaacagcaatcgttctagtcgccctcggctctgccagatctgttggccctctccgacatatgtttttggttcgggatggagtatgattactgccttagctgtaatacgcgaacagagggagcaacttattgctcagagctttgtcgccaagtagatcacgaaaaacctccagcatcaacgcattctacaaataacacaaggtcttccttggcatcaccatcccgactcctaacaatctcaaccgaggcagagaaggaattgagaagatatagcatagcactagaacaatcaagggtgcagagaaggagatcatgctaggtggaggaggtagttcactgaagcttttccggaagagccatcttaatagaatagacgtttcccccacatgagtgacccgaagtgtattcatctcccgtgaagtgcagcctcaagacatcttccactttgctccatactcgcttgtcgcgtttgatcgcttgtgcttacggcatagcttggtggttgtggtgtgatgcctgattacttcttgaaactggggcttgagttgagtcccaattcttggtacttagtacggccaaaccatgggtcaaggtgccaagttttacattgaagacaaatcttaggtacaaagtacatcgcatgaactattatccgggctataggaccccaaattggggactgaccccatcaatgccacgagtgagctgaaggccatatacgtgtctgatgtagaccttgaaatcagtccaccggcttgacaacgccgaggtatagggtaactcgctctgcagcaagcctcaaaccttgcctctatagaggttaaaattgcnnnnnnnnnnnnnnnnnnnnnnnnnnnnnnnnnnnnnnnnnnnnnnnnnnctgatgcacccaaagctagttacttgcctcaccgcacgctgaccgccttcctcaagtggctaatgttgatggttcgccgactgccattgctcgatttttatcgtactaggttgagactataggcactctgctcgacacaggtgcttgtgggtcgccagcaacccggcgtccattttctgcctcctgtctatccctgcatacgccattttctgctcctcgagtccattttctactcgtgtccattcgccttcccatttagtgttaggtccaatatccaaggcttatacgagccttttgtgtatcattcacccttagcatttcttaattactcctactcatttcattgtcctagcagcgtctcactttgtacatccgctctcatatattgcttacagatacaatacagtacaggtccagcgtagtaatctttatgggaagctcaaaggcagaaggacaaaagtttaatgaggccatttcactactcacatgggctgaaaataaattcaaggcatcacctatcaaggtggacaaatgaatatgcctcgccgaatcaccgaccgcatttgggaggtattcgcagttcgcccaacggactggggagcaggatgggagcatgttgtgccagtgatgacgtggtattacagcgtctacatgtgccaagctccagtccaagcaggcaccagaaatgcgagacgaatgaagttgtcgggggaaggaggatcgcaaatcaagccatcgcctaagaaataatgcgcatatggtctatcggaaaggcggggagtagaaggatattaatacgggttagctttgcatggcgctcctgtcacacatagtcacaaccgagctgtacagaaagatataaaccacccatcaaggtcgagtttcccgaggcgtacaacgaagctgaacccagtcccaacccagtcccaacccagtccccctttctatacaggcaatgcagcgtcctgattgcatcggcgatgagtgactatcttgcttcaaagcagagttaatagaatgttaattatccgtttacaggtaagtatatcaaacgagtgcaagaggaatctcccacgcgagaacgtgattatcacaggcaaggcaccctgcaactttgaattggtagaattagattatcagcctagtaattaacagatcaccacctagctagaaagagcctcgttagaagtctggtgtttcctagaacactgacggagccaccaacatcattttctttcttcttcccactgcctgtaccactgcgccatctggtcatctacataatcccaacttgctggcagttcatggcgggatggaagcaagccaaatggggagttaaatgttgtaggattcaatgggcgtctcgatgcggggattttgtatagctcagcaattatccagcgtttgaggcgttgttcggcatattgacgccaagcctcactgagaaaaccatgaccagtggtatattgatagtagagagctggcgaagctaactcctgtacccgtattaacagttcttcactgaacaattagagagtatttctcgatggaaatttagaagtagaccgtggaagaggcagtctctggtcgaatacgtgaaattcggcatattctaaaacgtaatccggcgtctgccccgtcctttccagtactggatgaagtggcatagccaaggtgtgtcgatcgccaactcgtcgtgagcctatgttttgcactttgagccgggcttatagttcaccggattgtacatacaatacaagctcatcccacccacttttcgtcttgctgcccaagacgtcttcgcgtccggcccaattaatgattacaggcatgtgaaagccggaaatggcttctttgtgcctacgctgtaaattcagccgttcttagccccagccctagaaacacaaccttttgtataactccttttttgtatatcctccccttttaggtatatacactccacatacatgtacattgttccttagtcaatatccaggcacttacctcaggccaggaatttcgactcgatcgtaaatgtgtggcagttcataaataaacaaattggctgcccccatcggcggacctggtcataaggaccatgacgcagtggaaacggggacaatttgcattttcactgatggaagtaggactcccaacgggctccacagaccctcgtagcgacaacgaaaacggccattcgcaaggccatgacagtctgcaacatggaaaacggccaacacggcagagagcttttcaaactcggcgcccgaccaagtaaagccatgctctcgattcacaacggtttacaccgagcgatcagttcggtcagtacgcagatgcgcacaggcaaaacgggcctccgcgcgtatttacactcggccaattccgggcagtgccttccacaggacttacaacacaaagtgtagacaggttatttttctctatgtagaagtaggggagggccggaaagggcctggcaagtatagagagccacagatgtaacagtttacagtactatacaacccgaacagtttgatatctgtgagcaaaggatgaaaacggatgtatacacccctgtccctacctagcccattctgtgtgctagcccatgatgggacagcccttccaatgggatagcacattatgtaccagcctttccagtagtacagcacattatgtgcnctaaataagattgcaccaagcaaagtagagggtgagaagagggtcagcgagcttgttcatagtggttagtactttcctattaatattacgatcttttttttatatttcagtaagagtattaatatttaaaaagttaataaaaaggtggaagatattcatcaagtagcaaccgagaccagggatacaaccaagcatatacaagacgataatcatctcaacaagattagaaactggctagcaccgcccgacccatccacgaatctaaatcaagcccgaagcctgcaccatcgaggaaccggccagtggttcctggagagtgaggcatattcaggatagaaaaaagagaaaaactcttttctatggctcaatggtatccccgggtgcggtaagaccgtcctcagttctactatcgttacggatcttaaccctaccaactctgatcccagagttatatacttcttcttcaatttcaacgacgttgagaaaaggtcactagagaacgccatccgttcgcttatatttcagctatatcccaagcacatcactcttcgcagtgaagtcgatgcagtctattccagctttgggaatggaacgagacagccagatacttcatcgctagataagctcttgcgacatatactgacgaaagctgataagatttatcttgtccttgatgcactggatgaatctgagagacacagcggttcatactcatcaaaatcattaatgggctggattaagggcgttcaagatgaatcaactaacatacacatacttgtcactagtaggcccgagcaggatatcatggcttctttcaacggctgggtccatactgacaaaattatccaactccaaagtgggttagtgagtgacgatattacagcctatacgaaggccagggttagcgaaatgccgagatggaagaaacggccagatatccaagcagagattgaaactacgacgctagatgcgacatatgcacaaattttgcgacggatacattcgcagcaactaagcacggcgaagcgtcttctgcaatttttgacttacagcaaacggcctctgaagcttgaggaagctgttgatcttatcgctgttgatccgtcaagccagcccgcatttactccagaaaatcgaatgccaattcccgaagaaatcatccagtactgctccagtttagtggttctcgcacatagaagcgtgcaatcttacctttctctttctgacacagtggaacaagtaaccgaaatacaacttgctcacttttcagtgaaggaatatctcttatcagaccgactggagccagattttgctgtaggactcgatgaaatttccgcaaagaccagtattgttgacgcttgtctctcctacctgctcaatatatatcagttatgttcgccagaagaagcggaacaacaatattatctagcagaattctccgcgaggtattggataaagcacgcgaaagacgtcgagtcatcttataaagcaattatgccgttggttaaggagtattttctatgccagaatgccttccaatttggatgtcaacttgaacatccggctaggctaaaagtggatggggttcaagcactttttcatgcatcccgttggggtttactttattcttgtatttttctcattcagaatggcgctgatatcaatgcccaagatggagattatggcaatgctcttcatgctgctgtatacagggggcatatagagatcgctcagatacttattcaggagggcgctgataccgacgccgaagaagcattttctggcagtgttcttcaggctgcttcagcaggagggcatctagagatcgctgagttgcttattgagaagggcgctggtgttaatgcccaaagtggatattatggtaatgctcttcaggctgcttcagcagaagggcatcgagagatcgctaagatacttattcagaatggcgctaatatcaatgcccaaggtggagagtatggtaatgctcttcaggctgctttaaaaagagggcatctgaagattgctcagatacttattcagaagggagctaatatcattgcccaaggtggacggtatggtaatgctctccagactgctatagaaaggggttatctagggattgctcaggtgcttattcagaagggcgctgatatcaatgcccaaggtggacgacaaggcaatgctctccagactgctacagaaagggggtatctagggattgttcaggtgctcattcagaagggtgctgatatcaatgcccaaggtggacgatatggtaatgctctccaggctgctgtatgcagggggtatctagagatcgctgagatgcttattcagaatggcgctgatgttaatgcccaaggcggcagaaggtatggcaatacccttcaggctgcttcagtgggagggtgtatagagattgctcaggtgcttattcagaatggcgctaatatcaatgcccaaggtggagagtatggtaatgctcttcaggctgcttcagcaaaagggcgtatagagattgctaagatacttattcagaagggagctaatatcaatgcccaaggtggatggtatggtaatgctcctcaggctgcttcagcagaagggcatctagagatcgctgagttgctgattcagagtggcgccgaacgaacagacaggctatcggatcaataactagatattgtctccataatttggagtgttggtgttccagcactccggtatcacggataaaagtctgttgttattgtctatcaaatctagaagtacagaggcctctgagattgtcttatacccgagggaatcttaatcgtccacacaggcctgtagcctgatattaggattattcttacccgtggcttcctctgctatcgcaaaaggctgacctgattatgggcacaccaaccccgatgtgtaagataccgctgctgtcagcagcaaatatcagttatacatataactctacttatataagatcaaccctatggtatgaatcaattgaataagttggccaatagaaggtaatagggagtccttgaatatatacagcagcatttcctttcttctggaacattctaaaatttacgcatgatgagcatgagcggccgtgacgacgaaaatattcctgagaccaactgagaccactaataatacaatacaaggcgaagtaagttatcctcaggttctttcacaagatatctcctcggaattttcatttaccgccccctctcgtgtattaaaggtttctaatgtgagacatcggttatagggtatatcccaaatccacatcatatgccgattagcaccacgaatacttcttgggagcctataatcgggttcaatgaaaaaaaaaaacaaattatccatagccagcttcgttcctcaaggctcctttgcgcaaaccgtgaccggtttgcctctcctgttgttccgcctctacccccgaacttaagcccttgccttgaggaacgaagagacgagaggccttctgcgccgctgaaacttcaccctgaccttggccgcctctgattggtgccttgaggaacgaagagacgagaggtcttctgcgccgctgaaacttcaccccgaccttgcccgcctcttattggtcagcttaacaatctgccctttgattggtctttaatcgacgatatacgactcttgttctattggtcctttttttttttttttaataaatatcttttatttttttaactttccctcttctttttccttccgcaataacctctgttatgattttgcatacattccatccactatctgctgtaattaatattctttcttcactgatccacagtgaagcttccctttagcatccacccctacagatacgaatccagcgtaaggaatttatcattagaattttactaagaatcgccaaaaataagccaagggcgttagatctactatcactaagcaatatacatcctggatatactatattagcaatcatataaataattatcaaattatatatagtatatagcagctaatatagggatatagtacagtagggtttaattttagtattagttaattttagcttccactctttctaggctggtcctatttccagtcttatatagcagaggtataatgtataactagcctctggatattcccctcgaagcaaaagctttaacggtcagatatatgtcctagaaatcgaagatagttaataattatacctaggttatttaataacgctagttcctggtcttccgctataagtattacagtcagctttcggttgattactattactatcgtaatgcccccgcaaccgccttattcctatcagatctatattaaagtaccagctactctgtattagctagccaatataagcgctcagccgtacatagctggttaggcagtaataaaaccctcaggtattttatagatcttgtagatttgcttaacccttaaatctatttcctcgttgatgattattcttttcggaaggcctgtggcctaatatgatatatacagtgcaaaatatatttctactctatttcgcactataagaccatcagtcactaaagcccaatccaaagagccctatcttggcgtctgttaacagcacctcttggcctgtaatcgataactatatacctgtatggatatatattgctactgtgatatcttcgtttaaactgtcggatatttttgtatggggttttacttggttgtacagcacagtattaaatactttaatcagtatctttcttgttcttgttatgtctatatatttcctttggcggatgttgggtttgggtatctatcgtaacccaaaatatggaactacagctaccgtaaaaccagcgggtaatatatcgaatattgaagttggtaatatcacggaaaccgggccgatgattttaggagacggaaataggaatacttcagatataatcttaagcctagagaagagaatgcctcaagactataacgatacctgtatgccaacagctgacactcctaaacgaaagttagccaatacagactatactatcggctggatctgtactataaagttagagcatatagctgcagctgtatttcttaataaaaaagacgaagagccagaatgtattctccctcgtgataataataattatactttaggtagagtcgggaggtataatattgttattgctgtcttactaaagggggagtacggtatttcctctgtaataagtatcataagagatatgctttatacctttccaaacattagaattagtctaatagttagtatcgatagtggtgctctaagtaagaagcatgatatccgtctaggggatattgtggtaagtgctcctcataatagcaatagtagtatatttcagtatgacttcagtaaaatgatataagatcgagaattccatataactaaagtcttagactaactgccaatagtcttacgaactataatatatagacttaagactgagtatgagattaaaggttattagtttgatataactattaattatattctcaagggcaataaaagattataatataagtataaacaaccagagccaaatagtaataagctatatcgaagcgatattatctatcctccagaatataactcagattgtgtagcagcctgcggcaatagcctatccaaattaatagtacgacggtagcgaaggaagggcgaagataacccggctatttattacggtttgattatatcagcgaaccagctcataaaggacgcttcagtccgggatagaattacagcagaaaacaatattctgtattttaagatagaagcagctggattaataaactattttccctgtttggtaatccacagtatctacaactattccgatatatataaaaacgatatctagtaaggttatatagtaatagcagcagcagcatatataaaagacttactatacaagattatattaagcaaagtagagggtaagaggagactcagcgagcttatacagagtagttagtactttacttttattttatatattattatcttttttatattctaataagagtattaatatctagaaagttagtaaaagggtagataatattcattaattagtatccgagaccagagatataactaagcttatacaagatagtaactatcttaacaagatcagaaactggctagcaccacctgacctatctataaatctaaatcaagcccagagcctatactatcgagataccggccagtagttcctgaatagtaatatatattcaggatagaaaaaagagaaaaactctttcctatagcttaatagtatgttacgaacaaaggcctccataacgggtcacacggtcacgtgcgccccacagtctgaaagacaggagcgacaggagcgatgcgctcccgtcgcggaacaaagctggatcaccaggagcggtacgctccttgcgctccatgactagtatatatacacattcattttctagatagaagacactctttcagacagttatcaatacaatcgtctacgcatctattgttactagctccacaatactcgcacattgacagtgacccgcattgcacagcctacgacaacctgatcgcgccactcagaacaacactctgattggtccaaccctgacctaccctagacccccgtccagtgtaagttgcccaaccgtcatacattgataactcttgttcagccgattaccttgtcttgatcgctgtgtaataacgaaaagacaccatgtccaataacgcagccgtcgccccgaacaatgaagccgaaaggcagaaaactcctcaggagatagtgcaagaccttatggatcgcattgtcgtcttggaggtacgaataagaagacctcaaaagtctccaaaagaccaaggagaaattgtcaggcctataccaccaggacccttcttgggggatgcccaagaactggaaggtttcctcatccagctataagcctactttgggtttttccctacaaagctcgcaaacgacgaggacaagatcaggttcgcggggactcgcctcggaggcgctgcgggacgctggtttcaggcctatctatgcgactggtatgagcacgaggaaatgccagacgccagagatcaggataccgtcaacatcctcaccagctacaacaatttcgttaccggaatcacgaacgcgttcggaaaagtggacaaggaacggtaagctgttaaggaactcaaggagctcgagcaaaaaggcgccgcctccggctacgccgcaaggttcagagagatcgcgtcgcgactagactgggacgatggacctctcaaggccgccttttacgacgggctcaaggacgaagtcaaagaccgcctattcgagcttgacgaaccagagtttttatctgaatatatagccgcagcaatatacatcgacaaccggctgtatgaacgacagcaacaaaaaggacaaaagcgaagcggttggaactatattaaaaaaaacaaacctaaccagggagtataacgatttcccccgctatctacagaatctgggacatactcaggtcctatggagctaggagctgtggaaaaacgcaaatattacaactgcaatgaaattggacatattgcaccgtaatacctaaaacccaagaagcagaggcaatagaaacctgctaaggaaggtaagaaacaattgggagtaatcgaaaaaacggaaactaaagttaaaacccttggcataatccgaagggtcactcaggaagaaactcctacgaatactgtgattcctgaattttccttactgtttgcgcctacccttaccaaggtattggagccagaagaacgataggaactcagtattgccaaggataattaaaaacgaatccgcaaaaaattccgagtaatccaataaaaacacaaagacaataaggaaaacttggaatacagacccttaacccagtacgaactcatattttactacgaaaacaaccttattaatcataacccagctgaggaaacatagtactaatgggcaagaaatgctgtacaggcggaatatgaagagaaccacgtatactacctccaaaagattaaagaacaaaacccagataacgcggatgtacttgtagtatatagtaggaggaccgctgaagttattaaacacccagacagttttcacaaggtgcccggctgttggaagaacacgataaaggaagaatactttaaagaattatagatgatgtgctacgacctatagtgtacaacgcactggcaacaaaaggttaagtacgatacctttctatggccaaatggtactatacaacccaagtataccgctaagcagacttgacgctttaagataagacgacgaatagttaaacgatataccattttcgaagaagatctggaagaatatcccacagagtgtaacatcgacggattattaactaaatactgccgagaacccgaatatagaatccaccgggaatccaagatcgagctgtagtataaacagaaggaacttgaggaccaagctacctttgaatatagcgaccgtatcgagaaatactacgactggaactgtataaaccacctggacaataagcaggaagcgttaaatatcgcgcgagacgcggataacgatagtaattatgctaaaaaacacctcgaacaagttcagaagtaggaagaagaactctacagatcctatgaactagccgcccgataggaacaaacggctaagggaagagtaactatcgagactaataaagaagtaaggtctgaaatcaaggaatggaaaaaggcttacgcttctatgggagaggagttcgaagaagaagcaaccaacccaaacaccgaagaaagggtagaagcccatacctcgaaggaaataatatacgagcaggaaacgctcgaaccacgagtcaaccaggcaaaaaacaacctaaaccgtctgtaatagggctacagcacggtacaatatcgacaataggtcagaggaccctaggagctatcgaagcaggaagctcaatttatatccttacggaaatagagatcgaggggaaccagctcacagtatttattgactgtggagcgcaggaaaattacatcttaccggcggtgattaaccgactccgcttaccatagagaaagaagaaagaaacctatacagtagctaatgtggaaggctcgaaatttgagtataacaataggattgttgattcagagactgattatcttacgattaaaatccaaggaaagaaattcgatgttatatataacttggtaccgctaggaggctacgatattatattaggactactatagctataagatgtaaacctactgattgattggtatactggctatatggagtggtggtaccctcctaagtacctaaatcaggatcaatggaaatcgaaatttcatcagacgccagaaaaacacgttcgtttcttaacgcctgaaagtaccactataaaaaacaataacaactcataacgacaagtggatacagtggttacagccttgacggcgctataacctggaattataagaaacttattacgataagaactaagacgaacgatacgaatcttaggtcggatacagaaataagaaccgccctcagatataaacttaatactaattgattaggaacagctaacaaaggaacgataataagaatacgaagtcaaatatagctgatggcaaaaagaagcagaaaaaccacccctggagctatttaatatcggaatccagaaatagagctgaataagtaactaataaaaggcgtaatagaataataaaaaagacgcctggtataagtatatacaggtgaaacaatcagaagaagaagaacagctgaagaatatcccaggagaatatagagtttacgacaaactattcaaggaaacccttgaaactagcttgccagaatacagctagtgggattataagatctctattattaatgaaggagaaccagccttttataaactttataaccttacggaacctcagttgtaaatactccgcgaatacatcgacaatatattagcaaaaggctatatatgattatcaacttcatctgcaggataccctgtgatatttataccaaagaaaaatagtaaactccgtttagttgttgactaccgacagctgaataagatcatatacaaagataggacacccttaccgctgattatagaactcagagaccggttatagggaaaacagtggttcaccgtgctagaccttaaaggagcttacaacctgatatgaattaaagaaggagatgaatggaaaacagcgttcagaacgaagtttagcctctatgagtatctcgtaatgcccttcggactaacaaacacacctgcaatattccaacgaatgatcaatcaagtactccgggagtacctcgatatcttcgtggttgtttacctcgatgatattctgatcttctcagacgacctaaaaacgcacaaggaacatatgtacaaggtcctggaaaaactagaagatacaaaactattagtagaaccagagaaaagctatttctatatataagaagtcaacttcttaggatataccattcgaccaaacgaaatatgaatagaacaaggtaagattgctgcagttaaagaataggaaacaccgaaaactgttaaggaaatacaagccttcctcggattcactaactactattaacgatttattaaggattatgggaaaatcgctgtacccttatataataccactaaaaaaggaatagaattccaatagaataataaacagtaaaaagtatttaatgaaattaaagattaaatactttcagaacctgtactatgaatattcaaccctacgagagaagtagaacttgaaacagatatatcggattttgcaatcagcgcccaagtcagctaaagagatgatgagggaaggctacaccctgtagcgttctattcgaaaaaactacacggtgcagagctcaactaccctatctacaacaaggaatttatagctattatacgtatattcgaggaattcgagcactactgcctaggaacgatatataaggtcaaagtatatacagatcataagaatattcaatatttcgccataacccagcaactcaatgggagacaaatccgctacactgaatacttatcccagttcgattacgaaataatatatcaaaaaggattggaaaacagaagggctgatacccttagctgtaaaccagaatataaacaaactgtacctaagacaaacggacagttacttactacgaataacaaaggacacttagtacagaaaaccttaggggccacgctcaaagagatagtatataccaaggtccagatagacactattcctagcttggaaaaactgtaataggaagcaagaatagcacttatcaaggaaatccacaagtatccgctctcaggatactaaggagtcaagaaaacattcaataggattaaacgatattataattacccaggtctacggaaggaagtacagactgtagtttcagactgcgatatatacgtacgaatcaagtccgcatgatacaaactatacggagaactcaaaccagtctcagtaccagaacaactatagtaatcaatatcctttgattatattgttaaactactaaaatccaaagaactaataactagagtagaatacgatagtattctagtagttatcgatagacttacaaaatatagatactttattctatataaggaagcaagctctacggaagaccttatatatcagtttctacgatatatagttagttaccacggattgcccaatgagataatatcagacagaggaatgatattcacctctaaattctggtaatcgcttatagtacaaataggtataaaacacaagctttcaacagcttaccacctgcaaagcaatagttaaacggaatatttaaaccaaactctggaataatacctacgagtatacgttaactatgagcaggataattaggtataactgttaccgacagtataaattgtatataatagctcagtacaggagttaacctaactattactaatatatacgaactatagttataaacccgaattccagaatcgatcagaatttggtggatcagatacaccagctgctatacttacaaaagaaatattatacttattatatactgaaataaagatagaactagaatttctccaggaaagaataaaaaaacactataataaaacaagattgaagggactaatcttgaaggagggagataaggtctacctactccgaaaaaacattacaataataaggccaagcaacaaattggactataaaaaacttagactattcaaaattttaaagaaaaaatcagatactaactacgaactttcactaccggatataatgtatatctacccagttttttatatctcattacttgaaaaagcaccagaaaacactccggaccaagattatccgatcgaagtctatgaagaagaatataagccggaggagatcctgaagaaagaagtcagaaacgggcaaacattttatctagttaagtagaaaggatatactaactaagataatacatgggaacccgttaaacacctaaagaagtgctaatgcctgattcaccggttccaccagaaggaaaaaggggagttaaatcggaaaaatcctccccgagacctaacaaattcaaatccgtctcaggagtaacccctgaaaactggacttcctccagagtgtatcactcagaagcctcaaggaagctaagaacctgatcagaggacaactgctcctcctcatcaagctcttaaagactacgctgaatttcctaccgcgccttactcttaatacgcccgcgcaccttgcgaatgcgctgaacacgccctaaggcggcagaaaggtcactctggagttaagttatttgttaatacaaaagaagaatcttcttatccatatcagattcttcctcagccagttttttccgctgtattattaatttttccactgagcaagaaaagtcagaaggaggaataagaaaaaacaggaggagcgctcacggttggatgtaaccagtactctatcgcaacgacgaccacttcgagcacacttatcgcaacgagacgatctcccaccaggaaggataaagcactccttcttcgccttgaaacacggagtacacggtatgtcggctggtaaaccgaacgtttgaatagcagtagcaagaagagctcgttcgcgagtcttgggatgcgctggcttctgaacacggttagatataatgaatatcacgatatggccatcacacatggaaaggaggaaaacttactaaaattatgcaggatcttaaggacaagaccaacggagagggggcatcatgttacgaacaaaggcctctataacgggtcacacggttacgtgcgccctacagtctgaaagacaggagcgacaggagcgatgtgctcccgtcgcggaataaagctggatcaccaggagcggtacgctccttgcgctctatgactagtatatatatatattcattttctagatagaagacactctttcagacagttatcaatacaatcgtctacgcatctattgttactagctccacaatactcgcacattgacagtgacccgcattgcacagcctacgacaacctgatcgcgccactcagaacaacactctgattggtccaaccctgacctaccctagacccccgtccagtgtaagtcgcccaaccgtcacatagtatccctgggtatagtaagactatccttagttctactattattacagatcttaatcctgctaactcttttgaaaggtcaaggcctccagtatagggtagaccagctgtagggtaagctgggtctagggtaggtacagcctatannnnnnnnnnnnnnnnnnnnnnnnnnnnnnnnnnnnnnnnnnnnnnnnnngtaggctaaggaatactgaagggatcgtttcgaaaggcgtagtggaagaggcagcctacttagtagggaaaagagacttgatcaactacagggtagctaagaagatagactgtagggtagataaaagagtgaattggtgacttgaagaacctctatctagcagggaggaagccctgtacttataggtgtttcagggctccaagagccctgaagataacacccctcttcccccaactgcagctacggctgcagaaccaattgctgtggcggcgagtctaatcgatctcaggtcaggtggacctatttactttatgcctgcgcattggtgaaacatgatgatttgtatttttttaacccctcgcagttagccaacccactcactgccactttcaccctattacataccgcattcgaaggcaggaagcaatcaactacatttctagatactcaagaaaaggaaacaagccgtatatgactattatatccgtacttcaaaaagcagaaagtagaatntaacaatgaagcggattcttaaatggtaatattaatgttgttctgtgtatacgaaatgatttcagtgattgtgtggtacacgaaaacaccatataattgttagctgcctcccgctgcactctcaatcgctgctcatacaaagcaagatctggattttaaatttaaaatttgataagattcacattttaaatggggtcagcgcggggccatatagcctagggcaaagtgtcttttaactctttatgccctcctccttggagttaagtgattcgttgatacatacaatgtacatgttgattggttgacacctggtgatgtgggtcagcaagcttgcatttgcgaacctaagagttcgctgatcacccgtcacatctgcagtaatcttggtgctgtcctgggactggtggctggccatacttgctgttccatacaataataaccgttggcaagaaatggccatgaaagacacagccataatacactggcataagcctttttgtgcttcaaagtattatgtagtctagacctaatggggttactcggtaaggccttaattagtctctctcgtagccatttttggctttgtgtttgatggcattctgcgtccaatttctgatcctcagtatccgttctgatttctaaccagccacacgccctagaatatagtagtcataggtactgtaaatttcggtccgtttccatgagattctatgagtaatcacacgaagagcctccttggaatgcgcatgtgtcccgaggacaggacaatgagcagcatgtacattcgctgttgttgagcccattctccattttcctattaccaacgatgtgtgccaatatctccgccacatcaaagattccgcaatgccttatttgctagctcatcggcttttgtgttctgttcgcaacgtacgtgctagaacaacacttcaaccgtcattctattcagctttgtaacaagcaactgcagctctcggaatactatcgaattttctaaaggtttctcctttgagtttctgaaaccattcttttgccacttgaaaatccattccgtcatccccttcacaacgtattctgagtcggccttaatcactacctgctgaagagggtattcagtcatcccttcatctcgtatcttgatcgcccaggctgtgtatttgtaagctgaattctcatgaacgaacacgctaattgacacaacggctgtgcttttgccattttgcctgcaagcgccatcaactgcaatgattatacagtctaggtgtagtgacaaacgaccgcaatctgtgcaaggctcatcttcatcgcatgccacgtatgtccacgcgttatcgtaattgtcaacctctataagtccacatcgtcgctgtagcgtagagtaggatagaacctccggttgctcgaccatgcttggccttccgctttgcaatgcgggtcgcgccccatattgcccgttcggctagggaaaccgtagtgcggcggagccacgaattcggaggcctggtaaagggaatacgttagatcatccgctgccagcgcgtatcaatcctgctggatagcagggtcccaaccctgtaacaaagaactgtctcacaaacagtatatattaaaatctaaaagcgtggctgggttgggttgttggcggcattcatctttacttcgttaagttgtgaaacaagatctatctgtccccaatgtggcgtgcgttgttgccaaaaaatctcacctcagtgaaccaacctctactcctttatccgcagagggagaggtcttggaaaggatgccttcggttgcttccggtgccttgtctcaagtgccagtggacttggaattcgagaagcaagctctcaaaaagttcgacatgttcttactgcctcaattagcactccttaccattcttgcctatctagatcggacgaacattggtatgtacccgatgactcactgtttcacattcatttgttaatcttgcgtaggcaacgccaatgtctttcggttcgccgaagggctcaagttgaaagggaataggtttaacaacctagtcacgtttttctacgtaagatggctctttggactgcgcaccaaatcaccaagggtttggcgaatctaactctatgctagattacctacatcatctgcgacgtcctctgggttatttctatccaaaggtttggtgctaatcacgtccttgctgtcgccatggtgggctggagcgcagcaacctttggcactgggttcaccagcagttatgagcaagcaatggcctgtcgactcatcttgggagcttttgaatctggactcttgccttgcttaacctttataatctctaccgtctggaaccgcagccagcaagccaagcgagttgctgtcatatattgcgcaacaaccatatcgggagcttttggtgggctggtcgcatacggcatccaaacaatgggcactcgtctgggtcttgatccttggcgctggctctttatcatcgaaggtggttagaagtgtgacggttaggcgacttacactggacgggggtctagggtaggtcaggatgtaaccaatcagagttgttctgactggggcgatcaggttgtcttggtgctgtgcgagtcactgctaatgtgcgagcactgaggagctagtttcaatgaaggcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttatgttactggtggtagggaagaaaagaaatgggtcccacgtgacctctgccccttgtcagcgtagattcgtaacaagaagatactttagaactaaaagtaagattttaaagataaacatataactaaataataaaattcttattttttatcattattttaggctaaatataaaatatttttagcaactatcttagataatttctttaaaagtttttagtttagcttaataagaatattaaattatagagaagtatgcgcaaacgttgataaaactgtagacggtgggccaacggcagaaagactcaaggtatgcactcaagatgttagcaggccttatcaccgctcttatccttcgcgtcggacaacttgagttacttggctatgattggttgattatccgagcccaacaggggtgtcagggaaaatgagatagtgtttgtgctgtacgtagtacgagatagctgactgctggcctgttataatcattcgccgcatcggcaattttgtgcatcagctgtggtctcacaggataagtggtacagccagtagtggcgtgctaccagccggccggagtggagccgggtagatctcgttttcaccctgtcttggtcctcgcaaagtctggccaatgaaggaagatgtataagccaaggctcgtgtcgctcagtctacacacgaagcaatgaaattccttatagtgactgcgtactccggggagagtggaaaccttgccctatgcgagagcctgagcgatcacaattttggggcttgatcggctcaaacttactatatggggaagcccgcatatcgcgagggggcacattctaatgactggattggctcaaaatttacgagcataggaggtccacatatcgagcttggatcagctcgcactgcccaagtcgccaccccagtcaatcgcccacccccctcaatcgcccactttcaatgattacatcgccaagtgggtgacataagggatgagatactaaatacttgcacattctttttagctatgtactccagcaaaggagatacagaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgcaaatacgcatttcttaacgcaataaaattcgtaaattaaaattgaagctattcaagttgccaggtgaagcatagatcttcaaagatataattctctaattcctgagccgagatctcggcgtctaattgacccttataaggttcccttgcatcaacgatgttggatatcttgacaaagcgtttacttggatccggatgaacagtacgtcttttcttcagctgcagcagcttatttgactcctttaattgtgtgttttcggtgtttgagatagatgtgacggttgggcgacttacactggacgggggtctagggtaggtcagggttgaaccaatcagagtgttgttctgagtggcgcgatcaggttgtcgtaggctgtgcaatgcgagtcactgtcaatgtgcgagtattgtgaagctagtaacaatagatgcgtagacaattgtattgataactgtctgaaagagtgttctatctaatgaaatgaatgtgtatatataacgagtccgtcacccgtctgtcactcgcccgtcactcgagacgagtgacgggttgatacccattggtcagggcttcgagtgggtccgtgcttcgcacgtgacttcatgcggcctgacggaggcctttgttcgtaacaatagataactgtatttgctgttcatccaggcccttgcagatcttacggaacagcagtcggatagtcgggtccacctccttctcacatataaagtcccgtatcaagccgcgaagctcgtgacttcctttcggagtggttatcgcgatctctttcctcttcattccggctactggcgtagtcggcggcgttgagggacgagtttgaaaggtatattgaggagaaaccacatacgggttcagcaaggggatcgcgatgttaactggccacattccagccgcttttcaacctgcaatatattagaaactgttaaggctgcttgcctagccaggtaataacacttgagaaacgtcatcttcccgatccgcgatgaatccgtctgtatttgttgttgcgagagataaagacgataggctctcttgagggcggaaaagatagataagtcaagtggctgtaaaacgtgcgatgaatgcgatggaaggaatagaagccagatatgatttttaaagcattcccacatgaattcaacagtttcatgactcttgtggccctcaacaatgagtaaacgccaactgggcgttgcgggtttagttgacgggataaacacatctttcaaccattccaatgcgattgaattagaagtccaccccttctcagaagctgtgaaatgccactccttgagatgatccaattcatcagggaaccattgctgttgaaccgttttccctttgagaataacaagagaataaggtgccgacccgttgcactgatacactcaattattgaagtccaatagcgagatccgggctgtatctgggcagcccaatgtttgcgagatgatccgagaaccaggccattatctccaattccttccataatgccggcttcatccatattccaacgattgcaaggagggatcttgcgaatgtcaggaatgtgcttgagcgcaaagaactcctttactttatcagctgtagccccctcaacgcgaaggaagtcaattctcttgcctcgaagagttctaacctccgggttacggcgtaaaaatccctctatccaatgcctgccgacgggttcaagatcaccctcttcgcacaagaggaaccccacgatctccttgacccttgcatgactcggagggaagccaattgagtcttggatgagtatccatttcgttaaacgggctccctggatcctcgagagccgctgccgggtctctgcttctatcgcccgcgttttccgacccggaattccccagcgctccgcagcttttcgctgcgaaacacctgattccacatcacggatagccagctgaaggttattttcggaatattcagacattggcgattcgaatgatattattttcaattgaaaggaacgaaaattacacgagcaattgcggagtgacgcgtaaggaaaagaggaaggttgggactgaaaaagtgggcgattgagggggggcgattgactagggtggcgacttaaatgcttgacccaatgaagcaaaagtaaaagcaagctccattcatgctttttggggttgggctataactgtcaccatgatttcatttgaagcaaatcagctcatggtaaacaatgccttagcttatgtgagaaaaataagaaaaagaaacttcaaatttaatggcgcaagcaatacgaagttttgatatctctcaatgctgaatcgctctagtttattccataaattcgatggccttgaggcctatgttctttttccaaaggtgagtgagcaaggaactttgaccttaactgagatggccgtaaagttgcaggatcgtccttgccgcggggcccgtcaaagccattccggccaccggctggagtgttgtgctctttttgtggctgttcggaatcttgttctcgctggtgatgatgttttaagtatgctggaagacgggcaagtcacgcgtgttactaatgtgacctagcatcctttaggtacacgccgaggtccccgatggaaagtgtcgctgcaggcatagacaagattaagaataggatttgggacaatacgtaaacttatcttcgcacaatacagtagctgtggattctttgggatagagggacaatacattcaacatgattgacaaacagacactactgtatattctatgggcagataattggaccctacttgtacagcatggcctctgcagaaagaagggctataatacctaatccgggggtggcttggtactgggatcatatttcattttattcggcgtcagctccaccaaagggatttccacatttgagtggtgctcatgagctatgcatacgtagtatgacttattacggagaacgttttntgatgtccttggaactagacattctcttgtcactacctgtaatactttcatcctcacagtttctggaatgcttcccacgtgatcacttgtacaaaacccttgtaacgtttaaccttgtccgctagagtctcctggaataggttgacttgtctatcctttcctgacacatttgcaagacttaatgccaatatcgtcggaaggtcgactaaataagaccctttcaagtatacgctggtctgcctcgatggcttgaagtaatggaagttagttgacatcttggtcaagtccatgaaaatgcctgacttacacctttgaggctaaattcctgcaaaccatatcttctaataagccctgctagcgcactatcgttggtattaaatgaatcggtgtcgaataaatcgatatcctcctcttcggagtcctcctttttaagcttttcgggtagaataattcttagtcccttgacttcaatctcggtctgcattagaaattatgttagtccatgacagttatagaataatgggaggcactttcattccccactaagaccttatattccgcattctccagtttgctcatgactcttacgatgaagttatcgaagtaatctctcgtaataatagctccgatttctctggctgttaattttcatgttgccattagctcagttcaggtcaaatgttaaaaggccttaaattttgctaacttactgcggttgagaacttcttttggcaccttatccaacttatataaaacaaatgccttagctgcccgtgcagcccgaagaagtgccggtctgtagtgctggtcatggcctatccctttattaccatctcccatatccgacacgcctttaataataccaagagctttcacgcctgtgaactcacaagcctgtaaaaatgcgcttgcctccatgtctaaagcacctacgttctgaagcgtctgtaaagacttcagttacccgtcttgactcgataaaatcgaatacttacagtatttttcactcgatcgaaaataagagaggcgtccatgcgaacagcatatccagagacgaagtcactatgtttatatagaggctggtctgtttgggcgatgaatccgtctattgtagcacctttcacttctgcgaccttaacatcaggcttggagactaacttatcgtcttccatagcctattttccttcttcatagttcaacgctctctccccgaaaataacatcttcgacactaatgaaaccgtgagtctctcattcgacgatattattttgggtatagttatatatacgcaatgttttgacccgagatagcagcgcagacaccgacatgaagagcaaacctaggttttagaactgaaaataacgtagccgcttcgatcccaaaggtttggattccttgccgtgaaggactagtcaagtaatacgcgaccgtcgaattattgttcagcctgaaagttccaatatgaaagtcaagcccttgcacttcagagaggctatcgacaagatcgctagagattttggtctccaagctaaattctttcaccagggtaattgcttctctaggtttagcacatataatacacagctgacatgccttgagtgtctccaagtttttaactctgagggtcnnnnnnnnnnnnnnnnnnnnnnnnnnnnnnnnnnnnnnnnnnnnnnnnnntcaatagcccgatatcaaaatagccggccaagcggggaaggagttggagtttaacgatgaggtgaggtaatcgagaaatattaacgaggttttatagcaatagaagagagatacacggccttgggtacataatatttacacacatataccgtaacgcctcgcgacagccacttattcgacgcatacgttgcccattgccgtcacatgtaagtggcgttgtataaactctaccaaatatttggcgatgggggtgaagtataaagtgctacacactttacacctatcgtcaaacttcttcgcccccatcgtcaataaggcatcatagagagttcatacaacgccacttacatgtgacggtaacgggcaatgtatgcgttgaataagcggctgtcgcgaggcgttacggtgcatatgcgcaagtgttatgtacccaagcccgtgcatctatcttctattgctataaaacctcgttatcatttctcgattacctcacctcatcgttaaactccaactccttccccgcttggccggctattttgatatcgggctattgaccacatctacattcaactattctgctagctagcccacatcaggaatagaatactactcattctactcctctacacatcattcagacgatcgaccgtctatcagtaatagctcagaccctcagagttaaaaacttggagacactcaaggcatgtcagctgtgtattatatgtgctaaacctagagaagcaatttccctggcgaaagaattttgtttggagaccaaaatctctagcgatcttgtcgatggcatccctcaagggcatgagttttatattggaagctttacactcgagaagtcccttatcccatattatgtgaccagcacttcacgacaaggacttcagactttcgcgacggaagcggctatgttattttcagttctaaaacccaggtttgctcttcatgtcggtgtctgcgtcgctatctcgggtcaaaacattgcgtatgtataactatacccaaaatattctagtcgaatgagtgactcacggtttcatcagtgtcgaagatgttattttcggggagagagcgctgaactatgaagaaggaaaatgggctatggaagacgataagttagtctttaagcctgatgttaaggtcgcagaagtgaaaggtgcgacaatggacggattcatcgcccaaacagatcaacctctatataaatacggggactttgtctctggatgtgctgttcgcatggacgcctctcttattttcgatcgagtgaaaaatactgtgagtattcgattttatcgagttaagacgggtaactgaagtctctacagacgcttcggaaggtggctgctttggatatggaggcaagcgcatttttgcaggtttgtgaatataatacagatgtgaaatctcttggtgtcatcaaaggtgtgtcggatataggagacagtaatacagggacggtccacgaccagcactacaaagcggcacttcttcgggctgcacgggcagctaaggcatttgttttatataagttggataaggtgccaaaagaagttctcgaccgcagtaagttggcaaaatttaaggccttttaacatttgacctgaactgagctaatggcaacatgaaaattgacagccagagaaatcggagctattattacgagagattacttcgataacttcatcgtaagggttatgagcaaactggagaatgcggaatataaggtcttagtggggaatgaaagtgcctcccattattctataactgtcatggactaacataatttctaatgcagaccgagattgaagtcaagggactaagaattattctacccgaaaagcttaaaaaggaggactccgaagaggaggatatcgatttattcgacaccgattcatttaataccaacgatagtgcgctagcagggcttattagaagatatggtttgcaggaatttagcctcaaaggtgtaagtcaggcattttcatggacttgaccaagatgtcaactaacttccattacttcaagccatcgaggcagaccagcgtatacttgaaagggtcttatttagtcgaccttccgacgatattggcattaagtcttgcaaatgtgtcaggaaaggatagacaagtcaacctattccaggagactctagcggacaaggttaaacgttacaagggttttgtacaagtgatcacgtgggaagcattccagaaactgtgaggatgaaagtattacaggtagtgacaagagaatgtctagttccaaggacatcanagcatgccgaccagcggcgtgtgcatcagaccgggcacgacgacgttcatgcggatgttctttgtcgcgtagatgacggcggtagccttggtgaactggatcacgccggctttggtggcagcataggctacctggggcttgccaatgtaacgcatgccagcaatggaggcgacattgacgacagcgccgccaccctgcgtctccattatgggaaggatgtggtggcagcagaggtagacagacttgaggttgacgttcgtctgggcgtcccagaccttctccgacatctcggcgggaccaccgggttcagaccgaccaacattgcttggcagaaaggacagtattagcgaaagccagatgtgttttggctgtggacagtctatggccgacttacttgatcagaatatcaatacgtccatacttctccatgcaagcgtcgaccgctgacttcacactctcgtaactggtgacgtcggccgaaacaactgtgatctcaccgccctcggcggcaatgcgctttcgtgtgtgttcagcggcttcaagatacaagtcgcagccaaagatcttggcaccttgcctggccagaatgcgggccgtggcagcaccattcccccacatgttctggtcgccagtctggccaacgccagtcactagaggtacacagcatggtgattagcgatcattctttgggaattctcatcccgcttgagaatagcaggcagtagagggtgttgtgtcacatacagaatacaactttgcccttgaggtctgggtaggtcgcgaagctagcttcctcgacgacgacatggttgccatcggtgttgccatttgcggtagcatccattttgaacaatcgattgggattgagacgtttaatacttggacgatcctaaacggggagggcgtctatctgatatgaggtatcgagaacacaatgacacttctgatgacaatgacttgatgagcttagctgacaacttcttctctgtgtcttttaagcagctatgcccgaaattattctcctgtgccgcggctctaatttactagctggcattgctgacatccttggcccaccgctgccacgaaatcgggattactccaaagtctggcctgtgtaagtgatttgtgctcgtcggaattacttcctattttcaaagttgttagagatgtttctgctccactctgacatgatattaggtgtaaaatctacgttcctgcgggtactagcagatgcatgaatggaattcaagccgatcgccgacaaaataaggctgtttatttgtcttggtaattggatcggaattggtttcagtcggtgttcaaaacacacatcggaatctcctataattccgacatcctccgccgtcggaaccctagcgattggcccaaattctgctcagaattccgaccccagaccgaaaggggatagagcaaacctaaaactcaccggaggcaaattgtcnnnnnnnnnnnnnnnnnnnnnnnnnnnnnnnnnnnnnnnnnnnnnnnnnncttactccgcgccaaactccatgttcatcagccctgtcaatggcctcggacaatgactctgaggagcatctcacaagcctgtgtatttccgtctttccatagcaagcgatgagatatctagcttgagacaaagtagctaatcagaatatcattccaactgaatatccaagtcaacgacaaagtcaagaccttggaaactgatatgcagatcccggtggaaacgttaccgccgacaaggagaaactcgtaggcgtcgcttcaatcagtacatgactaatataagtattcatagtagtgagtgaaagagacaggaaaatcgattaaccgaccgacggttcagcacctaaaatagcctcccttgaagcctcctccagcaagtcaaccaaccgctccatcgtcacccggtccgcacaatgcatgagcagccacctcgcaaacgagggtgcagggactagcttaccgcctgaggcttgcttactcacagtacacgccccatccagcatctcccttgtgacttggaagtgttgctgttgcaagagaatatccttcacctccccattctcaaatgtaccaatcgtcgggggctcgataaagtcaagctgaaagaggtcaccaagaatgaacatgttgtcgttggttgatagctttgaattgaacgcatgctgtgagtcattcgctacaccgccagcgaactcacacaactcccgaagcagtgacaccaggtgcatctctaccctcaggtcctcggccggctctgccgtcttgatcgtgtataattcctggaagaccttgtgccgtatttccggcttcttcttcatcaaatcaagcactgaaggattaattaggttcattattgtcaattctcgacctttatcgtttaccggacattagttgaaatcaacatccatccacggtgcagtccgtcatccctattccagacccccgacaggctgtcagaatttacgcagccgatgtcgctcatcattggctagatttacgagcagtattggtcagcgccaccaaggcagacacaaaggttataactgcagcaatcacttgtcgcaacagcagacagttaggtcagccacacttattctcaaatttaatatggttattatacaagcagccttatcttattagaagttaggtctgcagccatcgcacgtcttaattgacaatgcacatgtcaggtctgcagtggtcgcattagtagcctaagtggttgtgcactgtagtgtagggctgtgttttttctaaccaatgagatgaagcgcatacgccatggccccacccctgggctccaagcacaccaaatggctctaaacgcaacccacttggttctaaacgctgcagttttgctgtcacaacctggcctccatgacggccgcgccagtcacgtgacggacccaaagccggtacgtaccaatcagtgagatcaacgctcattgggagttcactttgttgagtgaagtccaagtgaagcccgagtgaactcttggatatatatacggacattcattctctagatagatacactcgctagttatcactaacactacagcttcctagctacattatccaactctgtaactagcgactgatagattgacctgccgatctccctgcaccaacggaccaacaaagaccggtctatgtctagctaccctgtagctagtcggaccagcttgtcacataaaactatagtttaaattcttaaaaacataaggcaagaagttttatatattccatttttatttaagttaataaattttttagtttatattttagaagggaaaatatgagacgtataggcctaagcttaaccttatgttgtttatatgatttcgtcaagcgctcaaaccgagagctgctggacagtcggtttctctcccggatatacggcacttaaggagacacagtctgtttcattggctgctcgctattaatgttaggattatctctagccggactggctaccatcgtcaacggaggctgttcctcggattgtaaagtttacacacattggggtcccatatctgatatgagcaggagacgggattggctaaagggacatggtgctatcggagggcagatctattggcatagcgctgtcctcgttttcttgaccaatcatgattgggcactcgcgagtgtaaagaccagacgtctgacgtgagttgggctgtttcaaatgtgaggcgaaaacaaaaaaagcctcattgtaagacgcttcctcagttatggttagggaggcaatacaagcagctagctcatcactgtgaggtttgggaatccatcgtcctccgtagagctatattatcaatagatgggtgccttcacatcagccgcgttgcagaaaaagagaaggatagcatcataatcggctaatgtaatattcagttccaggggcaggcactgcacaccatcatctggtgacgtaagattgtgccgacgctagccgatgacccttccaggggaagttagtacatcccagataggaccagcgaccagcgatagcagcatctcttgcaaacggggccatctaagcaccctcagttgcctacggtcccacgtgcaaagatagaggatcccaaacgagagtgtcataggctagagacgcatgagagttcttcatcctagtccgctttcaatctagctctagcaattagaggagaggctaaccacgacgagttaaacatagatgggtccagatcgattatctgttgacgattaccggctggggaacgtgacgataaccggcttgaatcagggaagggacagaagcattggaccagtgagaagctggtgatgccagcctgtggttgtttccggagtgtccgcggagacaggacatcccctctcactttttctaccctgcttttttaacaggtcacatcacgccacggcgtgttgctttctccttgcacgctagtttctctccatgcatggccttgtagtgggatgggcgcgtcaagtatgcacatcacctagcggaccagctggacgacgcggagggacgagattagcatcttggtcaccataaccttttgacctaaatcttgccgtgaaacgccccgtccattgagaggcctcgcagatcctgcccatactgtttggtcaaatgggagcccgtttcaaggtcgagtcagtccaaggcgtactaccgttcaatagttacaaggacgacgccgcctttccccagattctactagtgtctatgggacttgttggtgtccgctgtcaaggtatgggtgatacgatcgaggcctggttccgccaagaattgatacagacaagctgggcttatctgaacctggtcgcttaaaaggagagggtgatgctctactttgggctccgtccattctcccgcccatcatgtctatagagatcgccatgaggctacatccgattgattggtaaccacacacacacacacactctctctctctcgcttgctctctattcagtatttctttatggaaggtgcatttgatgcagtgtcgcgcgcgtatgacaatgttcagctatggcaggactccagactaatgtctttgttggcttcggcatcgtctggacgctgtctgtcctcgccataatcggccgagtcatcgctcgccggatgaccaagattcgatggtggtatgaggactacttttgcctgtgtgcctttgtgagtcgatgaccagatcttcacagaaaagcatatgtccagactgacagaatatgttccagatctttgcatgtgcccacaacgccctctgcatttattgtaagagagacttgtctccattgatgctaccccccctaactgaccatcgcagggtgcgcgaggtggtccctcggccaaataattcccgatgacatcgacctcgccctccacgacgagatcctttaccactcgcgcaagctgggcttcttcgtctccatcagctacacgtgctctcttggcgcatccaagctggccatcctgtccctctactggcgcctgtttcagtactcgtccattcgtatccccatcatggtcctctttgtcgtgtctatcgcttggctcgtcatgcgtatcttcatgaccgtctttcgctgcacccccgtgcccgcctattgggacgactcgctcggcggcagctgcaacattaaggactcagcctttttctttggcacaatcatgtcccatttcttcattgatgtcattatcctgtccctgcctgtcgccgaggtattcaagctccacctgccccttgcccaaaagtttgccgttgctgcgctctttctgctcggcatcgtgtacgtgtatattttccctcctactcccattatggccgatctttgctgacgggatacaagtgtatgcgtggcatcggtcaactgcctcatcctgtccatcacggccgatgcccatactacgcagatgccgtatgattacgccctcaacgagacatggggcggtgtcgaagttaacattgccatcgtctcctgtacgtctgattcaaacttacctccctgtctccctctgatacacacacatgtacaacacaacctcaaaagccttggaaccacccttgctgacagacatagcctgtttccccctcctccgtcccattttccgctccgttattagttcccacgtcctcaactcgtacctggatacctacacgaccaacgccaccagccacgcccaccgcacatatacatgcgccgacggcgtcgagatgacgaccctgagcaagaggcgaaccaggacaaacaagagcaggcttgggggcgtgagcctcatcgccgacgaggaaaagggcatcctaggggatcccactgcctgcctggatctaaaaacgccagagcccgtgcacacgacgactacgacaatggcagcggcaatgaggcatgggtctggctgcgagtggttcgacgtgcatgacgaggacgacatacgcgtgcagagtgacgtcgtggttgaggtgcatgaggtgaagcgtccagtatcgtttggaagcgacgggatatcataaaagtcttaacgttctctgcatctatctgatgttgcttggatttttctttgtatatatacctaactttaagctcgagcgatgaattcagccatttgcgtgattcgtgctgccacatagctagatgagatgatgtgcaggtactttctggatcgggacgatgcatttgatgacgatgggcaatgatttcaagggtatctcatactcgaaagtgatatgttcaccccgaacatggcggcggaggaagttaccgaccggtgtgcatatgatatacctttgtttcctagtctatgaccagtggcggaaacttgctccgtcatgattgccatcgactgattcatagaggacaggatggataagtgacactgcatggtagagctcatcgaaggggatggatcattgctaagtactgaaggctgcgtcggatccaaactctgacccggcctcggccgcgtggctcgaaagttgtgattgtgattatccgtcaaggttgcactccactttgttaattcgtcatgttctcctccccatccatcccacaactcgctcgtgttcgcacatcacccgccacacgccatcaactgctggacatatacgcctgcgctgaacactgataagcgagcggcccggacaagcgaatggcccacttcgccatagcccaacatctcttgaccctataaaaccaactataacgttatataattgagtcaaatcaatcgttagtgtcttcttcagacagttttacttttatctgacactttcgagcattatgccctgtcttcccacagacaccacatcgccgttgcttcatttctgccttccgcttgtgacccccattttcgcgaccttcttcttgtaactgcatgtcaacatcattttggccttgtaaatcttgtccctgacctacagttagacttcttccttgtcttacgcttctttttgttacgtcgacgtcgactaagcgtctcattctctacgtcgacgtcgactaagcgtctcattctcctcccgaaggatctgcacctccgacttcaatagagcgatctgatgcatgattccccgcgttcctttcgcaaactgatctacagcattcaaaatcgatgttggtgagctaccttggtgtctggagattcgggacttgatgaagtccgactgtgaagtcgcttcaatcggattgtttggtgtcttagagacccaaggggccggtaactcgtccactccaaggattggtgtcggcgtacgtagcttggcatcgagcctagagatcacactttccgggctcagaggcataagccctgcgcctcgaaagcctcctcggatgtttgtctctgtcatagaggactggaacgctgcgtgaaaggtgggaaagaagtcctccttgctgatgtagcttgtacccgccctcatcttcttctcgatctgtcggccgtacgcttgcttgagcgggccaaaacatccaacgtcaagaggctgaagtatgtgagacgagtgagcaggcatacagagagtaacgatcttcttctccttgcagtacacttcaaagcctgccgagtggtgactttcatgaccatccaggatgaggaggcgatagccacctgtggttcgcgacttgcttgtgcttgtcgaaatgctttacccattctagacctatttcgtttgttgtccaaccattttcagtcgtggcgataacccagtcctgcggtagaggactatcttgataccacgtcgagaggtgatttttgcccgcaacaacgatgaacggcggcacgcaccagccttcagaataggcctagttgagatccctctttatctagcttagaataataaagcggtgaaagtatggattttcttccttttttcctcgctcccactgaagtatgtcgggtgttgggcgactgacttcagtgggagcgagcaaaaatagagcggctaaagtacgggttattggctaaggtatggcggttcggctaaactctggctaattcggttaaatactgggtaaataaatactttttatgggttactggaaattattgaccaatcaatcaacggactcttagcaacggatcctaccccctaccttttagtagcgtgaaaattcacccaccaaatttcaacggatcctactaggaaccgtcgtggcattaatgatagggtgtattatctatagtatattaggctgtggtactcttggttttcttccgggatggatttattttcttcctctgcagtatactttacccccctcttttatataggtgaagcgcgatatattaccctgtacgtacgcggcttgatactttgccggggtagtatggtgttttaatctgctgcccctttatatactgtagataagtcttggtatactgccttttccagtagggtgagtttcttagtagatcctgtacgggataataggtatagtaatattggatttagccggttagtatactggaccgtaatattagtatctagtatatttttatctatcgagtccctgtatatattcttaatcccagtattccgactgactctaatctactggtctctttatagctgcggtctatttcggactgaattcgctgggggcggattgaaattataatttatctttgctaattagtcttatatttatttactgtatctcttcccttgttttactatagtttatattatagtctggctgctattatagggtaggtagtatatctggtgagaagatttctaagatgagttatccgagtaggggtgtttaagttttctaatagctatatagttaagtatttagtagggggctatctgttcaatctatctacctgttcgttgctgctattctactggtatagatattggattatacctggttctgctagctagtactgttattgatttgtattctgtggattgttattagtataacctggtgcttaggctgctggtagagcctgtccctgtctccgtctccggcgctgggttatccagtctgttctccagttatatttccgggcttctcttgttactcgtcgatggtgggttatttattggtataatatatcgctgctagatgtatatatagatatctgggtgtcaggggttacagtctgggttagcgaggaggggggggtaaggttaggctgcagccggttgggttatatatcttggttgtactggttcggtgtcagtataccctttggttggcaggtagtatatacttatacaatcttactgaaaagacgatctaggtcctgtactgacctgtcctttatataactgactatattgatctcgaagggccggccctccttgaataccggattaaagctgttctggttagacccgctgcggtggaatggcactatcatgagatacccgaatataagatcttcggccttgatcgatggtctgtcgggttagctgtggcggagctgctccaggagctacgagggtgtggatccggtgatgctatcggctggtatatcatatgtatttctgttgagtctgtattgctctcggagaccggcatacgcctggccgaacccgaataggcccatcttgtggctgtcgtcctctgggctgttacttacatcctcgtaaaagtacgacttttagttcgagaggcctgcttctccaggtgcggagatgatggagacgaagtgctatatactgtacatcttgggcgtggtattttggttagccttggacttggtaattatcatactatcgctgggccacggcaggatccagttcgtggccaggacgagccggcagaggttattataccaggcagcagcctcctctgtatctatggactcggtaattatcatcatggccgaggctgtcgcgaccctgtagggcttggagttccaccccttgcgcgtctcgatcgggtctttatatgcccaggcccgcgccggtcgctggttcgggggtgcaaagaggtcgtcgaccagttccagcggctcctttgtccgcatcttgttccccgcaacaatgtatgggtatatacgggttcggttggtctggcggttgtggaagagctccttcatatcatcgtagaataggcccggcgggttgcgccgtgctgtagtacggacgccgtcggcgaggttcccatccgtcctggtcgcctctgcctgggtgatgtggtgccatatgtcgcgcgggaagagctcgaggacggtgcagtggaggtagtcgagccaggcgcgtctgatcccgggattggcgatgatcgggtgcttagtaagccagcccttggcctgctacattcggaagtgcacatcacggatatcctggaacgcgtgccactgcctcttgtagtcgttgcgcagcagctcggtgccgaccatgagcctctcgagcacgtccttgtggaaccgcgtaacctcccagtcgaacttgcccggccgccaccagccgaagccgtgcagcttcatgctcctgccgatgccgagcccctcagcctcgaccgggggcctgccctcgatctgagccctggccggcgtgctgcggtcactccagagcacccgctccagcggcagcaggccggatgtatagcagaaccggagggagcgcagggcgatgattatgacagctgtctcgtcgagcgagtacttgggcccggtctgtgccttgacaagctcgaacaggatacagtaccggttggttatggcgcggaggaaggagatgatatcgccagatcttacagcaaagaacagctctacatggttatcccccgggggctgcacctcggattcctggtcctgctggatgatatgcccaagcaggcttattgtaatccggtcctccgccctcaccctgtatgtgactttgtaattcggtatcagtcggccgtatccgtcgcgcgtgaactgcaggtaggtatgcatccgctgcttagagagctggtaggacttgatgagggtatcgatgctcttcttcataccgcgggtggactggcctacctggaggaggtatatcggatcgatggccagtatttcggttgcttgtgactggaaagggtagatcttggcggcgttaaatagtagcttgatcaggttgtagtactgggtgtagaccaggccggccttacgctcggcgctatcgggaccggatataatcgttatagcgctggcctcggaggttgttacccactggtagtagacctggcggaagttctttctcgatgagttggcggtacgctcgcctgtattatacgccctgctccagctcctacgctctctggcgattgtctgtaggcagtaatgccgccagagcaggacgtggttgtcgagcggggtgttgggggccgggatgtactgccgcctgaggtcgataaaaatattatcttctccgataaatcttttatctatagctccccgttatatcttctggaattccgcgatcgctttatgggctgaatttctagtatacaggagcttggtattcttggcgctgatatagagagtcatggtactaaagattgtatagtccgtagtatgtgctcggatagcttcccatatctgctccaggtattacccctggatttggtataataggttcctgttccccctcccgctcttaataccctggtatatatctggctccccctcgccgtcctcttggtggttgcctggctgcttagggctactggtctggtccgtctgcagctgctcccgcctggcgcgggtatcagccattatagcctcgtagctcggtgggtagtactggttcatactggcgcttgtagcctcctgtattgctggcagtaggatattgtcggtgagctcctcgaagatctccctgggtattgctgtgtgtttggcggggtccctggactctctggcgagcgcggggaagaacagctatatatatatactcggcagggttaggatctccccgaagcagtagttggggatctcgtgcatcggtcgcataactagctcgctggaaccctctgccgggaggggtaggctgaggtgcaaatcctcggtctggctgtaggctgttataacagccgagtgctatttgatcctatacttagcgacagcgagagacctggggaaggcgtatatactatcgatatcgtatattgtgattatattatctccgttgcccgggctgatactgtggtgtatatacatacagagttgctgcggtggtatcggtactgtacatcggccctcgaatattggctggagatactgtgacagctgtattgtcttcgcaggtatatcgagttccctccgccgtatactagggtacatcaggtcttgtttagggtcgagtatatcggggatctgatcgttatagcctgcggttggcccccctatcgtgttcgtaatatcggccagggagctgcagctgctgttaatctcgtctgactgggctgcttcctggataatcttttcgtacacatactcgtacgtatctgcggagcagccgcagcagcctagccactcgcacgccaggagcagctcgagtaggcccgaggcaggatcagggttaccctgcggtacagtagatactgcaggcgggctgaatagttcggtaagctgtactactgtaataggctctttcctgagaactatgctgattagtatatcccatctcgagaggactataacctctacggtctgtttattctgaagggcctgggggaccgccggcagtattaagagatcccatggggattggttatctgtatacttgtttataatatataatataagatagtacaggttctccagtataaagataccacaggaccagtctgactgttactgaatggcggtaatagggaatatctgcagctggataccgccgttgagcttggatacccagtcctatagtatagcaatcgcatgctcagggggcgcccggtcgagtaagtccagtataatcagctggttcgtattatatatataggcagcgagcgcccagtatcctggtatatagtatactcttaatacagtcccgtatagtaccggtataatagcgatagtcgcattagctagagcaaatatctcctcgtcggagtactagtaggggattatatcctcaattactactgcccttactgctataattaagccctctatactgcaggtatccgcaataaacctaagcccgctagtaatattatccaggtcgagtatctgcttctcattgatcctgtgctgtatattcaggagatagatccgctgttcgatagcctctctgttatattccttctctatatatttaaacttggctctgaaagcatagatactcctatcggagaatatccagcagctatcttaatccttcattaggggggggatatagttaaagaaattatttataaataactgttattcagtctgctgaactggcggggtcggggttatatcctgacctgagaagctgtattatctgggcctggatctggttgatttagctagtacctggggggttattagtactgtcagttcatatacaggcggtttctgctcgagaggtgttaccagctcctagtctgatatatatagtttattgctgatctgctctctgatagagctgagtatctccttaaagaatactatggataattactagttactactatcctcctcatatagctgttctccaagttgtataagctcctcatctataagcactgctggggatcttcagctattctcagcagtctccttatcctattccattattaatatatcagtataggacaagtagtatactaccttgtattatattactttatacctggaggagtatagagtctggcttatagaagttctgaggaatatattagatacttagctctgagttagtagtaatatatatagagttctgagtatatatctagcttagtaaaaatatttacttagtatagaggccagtatttgggttagtagatagtaggacttagggtggtacaggctggtagaagatataataagagtataataactggttaggttaaggctgattttttttcttttggtagtatttttgagtactttcttagtataccttcttatagtcttcagcagtagttaattttaatggacagcctcttttcttctttggttctgctatatttaaatatattattattaaatattttaagtagtaattgatttttttaggtaagagataaagaatggagttagagagaaaaggaggagtttgcttacttaatataatatctaacttagttaggctttaggcttattagtttctaattatagttattacttatcgttatctataaaatcttatagttcagtagttatacttaagtagatatatagtaagttcggttatagattttaatctttttatccgctcctactgaagttagtcggggactgcccggactacccgacttacttcagtaggagcagataaaaaataatataattagaatctatagtataggaagtctttattatatatctagtagttaaacagtttttaccagagtagtagatagttagtaaggatacagaggaaaaagtaaagtcattaaatagaattatatttcaccggcattcaagaagctagcttattattataatattactaccgctcgctgcagcgctttctcttgctgtagtgctttcgcttactggcgtcgctatcgctcgcttacctctgttaccattatcaccgtcacctctattactgttactattatcgccgctgttatcaccgttgctactattaccagtattactgctattactattatcgccgctgttaccgctatcacctccgtcgctattatcaccgctatcatcgctattaccgccgttaccattatcaccgccatcactattattaccgctgtctctatcacctctattactgtcgccgctatcgctatcacctctatcaccatcaccgctatcaccattattacctccgtcactatcgccaccgtcactattatcgccgccatcaccaccatcaccatcatcaccgctgctacctctatcaccgttatcactatcaccactattacctctattacctctcttctctcttaccacgaacatatcttttccttttctctgggtcctactgtcggtatcgaccttggtaccacatactcttacataggcatcttccgcgaggacagatacgatatcattgctaataaccagggtaaccgaaccaccccctcattcatagccttcacagacaccgagcgtcttatcggtaatgccgctaagaaccaagtcgccatgaacccccacaatacagtcttcgacaccaagcatctcatcagccgcaagttctcagatgctgaggtccaggccgatataaagcacttccccttcaagatcatcgagaagggcagcaagcccgtcgtcgaggtcgagttcaagggagagtccaagcagttcactcccgaggagatctccttgatgatccttaccaagatgcgtgagaccgccgaggcctacctcggtggcaccgtcaacaacgctatcgttaccgtccccgcctacttcaacaactcccagcgtcaggctaccaaggacgccggtcttattgccggtcttaatatcctctatattatcaacgagcctgctgctgctgctattgcctatagtcttaataagaagattaagggtaagtataatattcttatttttaatatcgctggttatactttcttagatatatatagaagtaatagaaggttattaagaatataaagtagaaggagagattagtatattaggtaaatattaatatctatatatagataataagttaagttacagatttagatctttttatcttactcctactgaagtaactcgggtagtagctgactgacttcagtaggagcgggttaaatagataataactagattctatagtataggaagtttttattatatatctagtacttaataagaatagctataattttatttattagttaaagcttaaatattataagactaggctaattatatttgaattattactatagtatactaaggtagagataaaaggtaaaggtctaggttttataggttatactgcttagcagcctgttttaatacttaggtgtgagaatctgaggataggtatgtattttaacctatagtactaacctatttgatttattatcatatacgccttacctaattaggatttaaagtcataatccaccttacctaattagtttagtactaggtttatctctaaagaaaattcttagaatttaaataacttaagaggaaaaaatcttaaaaatatagggtaggtatttttagaattacttattcttaatagactttaataaaatataataaaaatatttttctatttttttctttttaagtatattctaaccctaaggtattattctatatatcagccaggttttctctagatatacgccctctaggtgagctggtggatatataccacacccgcaggctactaaccctctcaacaaggtttataccctgctcagcataagctcggataatcccaataagatcaacgcagcagggttatcggtcgactacaacacttcatggaaagacatcttccagaaacttgtcaagttctctctctcttatcaagtgtctgtaagcacttacatgagccaaatctgcgtcagctaagtaaccccacggatagatttcctagcgtatgaagtagtcaaggcgatagttgtattgaacgtaccacgtgactagggtaaaccctagttaagaacctttctttagagcctctagctaattttttagacatcgccgcctccgaactttcttaggacagaagtgtactacgtttattcctttcctattactcctaactctggtccgcaggttcagtcattatctcccattcccgagatcgttaccagctcttgatcccttatataacatcgctatggggtctcaatttcacttctttcctgacttgccttacgacctcaggcataagatctatattttagcgacacccagcaggatcgtccgcttagaggaaggaccggtcgatatcaaggagaaaggcgcgtggaagcaacaaggatggaagtcctacttcgaatatgcttttcagaagttcagggctcgaatgacggaggatacccataactggaatgttaggctgcatccagacttggcccattttgctcataattggcgtttgcgcataccgtggtcatctcgtcgctataagcaaacaaagttggaggactacggttttcactctagtctgccccagtatgagccttgggagcccactgacaacgccccgtctattcccatagagtggcttctcaactttccgcaactagcctttgagctaacgcgcgaaggatgcatgtacagtgttgctgcggtcccccccttattaaatgtttgtgccgaatctcgccaagccctaaagaagataggttaccgacttgcctttgcaacgcgcacggcaggtcctagaacatggtttaactataagctggatctcctctatcttccttccgcgaacaatgccttcccttggtcaccctatgagtcgtaccgcctaggtgatgcctcactgcccgttgccagcgactgttctatatccggaacacttctttctggatgcagttgggatattggacaacttagtttgcgagatttgcgagaggtgaagttccttgttcttggtcgtggttgtgcaaagctatgggaaacagaagtgatgaacatggagatacaaaacattttgcctcttttctcgaatcttgaagagatatacttcgaacattggagtgtaaatgattttacaggctggtttagcctctccagtggctgttctatgttgaaggcgcatagcgattggacatctccagcttgtcttcctgctgaggatattgatcttataggttcgatctactggactcggcagctaccgttctactggctccagggcgaacagaaatactggcccgggctattttttcatgttgacggagtggctcatactttcttcaaccatatgaaggatcgttcttctcgcccgctctttgaggtactagcaacgaatctagcaaagagtctgaaggcgtggaaagaaagtcctgggtcgccgaagaattgtgatgtgttgattcccacctttcgtcatgtccacctaatctcgaaggcattatcaaccgaatttctcactaatagatatcgattttggaacttatatcgatctctcgacggcaacttgattcgacagccagatcagcgaatgaacgtttctgatgcctatgatctttcgcctccttttcgtataaattgggatatcattcgccggttggaaaggagttcgccggggcttttcgatactatagaaagatctcacgcggagctagagttagtagataaaggaaattggagccttttacaagtttggtatctcgatcgttttgtaatcaatgagcctagtgtagattatctgtagcttttagaggctagcggtttggttagaaaattaatactctatatctttgcatatttgtcgtggtgtcgttctatggcctacggcgagcatgaaaattcaaggttggaaactcgtgagaataaagtgccttaatttctctaactaagatgccctacgagtaacgtatttgtacaagagaaatggcaaaatggcacttggcgtccgactagtaaaggtcgtactctcaatacatgacggttcttagctccttgcgagattgtgactgtttcaatgcttggctgtaatactggctgggtgccttgaggaacgaaaggctcttccttccgcccccttcgaaagcaacacctggaacaccgccacctgcgccacaaaaccacgccacttcaagccacatctcaatagccacagcttagacttaggggccaaaatctcggagccgaagtcttgaatctgcataactcaaccacctcatttaacctttgctaagttttgtattttccagcgaactttattgtggacactgataccaagttttaggtctcgagtccaaactgtggcaccagacggtgactcctatcatagcctatagcatgaaacagtcttacggtttttggctcctgcttatgacacaacacgatgccacgctctcccaagtatgtactgatattttggtaaacctcttcgccctcgtgcttgaaagccttcacttctagctccattaggtggaagagtcccgcctgtacgtcgtccatcacagccctgtggccggtgacgttcagactcgggcttgaagctcaggggatcctcaaaataatccgcattctcggagatgctagcgtgatttatgacgaaacttgttccttttaggaaataataaccctcgaattctagattctcggtctaagtgtgctccggtgtccacacgaagatgcctctccaccggagtatccttggcaaacgcgttaacatacggtagactctcttcatcgccaaagtccggaagacgagcggcgtcggcgccgcagactcgatcgagatcagccctcgctttcaagtgaccgctgctagtatcgcaatgttgatcgctagacgggtcgtgtcactccctgcttctactagttgcatggttaggaacattttgtcggtgtcactgcctttgaatttcgcttcgccgaggaggacatctcggtcaaatgattggggggcctttccttcgagaatattcctttttatgggggagtagtacgcgaagtaggcatcatgagtgaattttcctgcgcgttcatacgtccccggccaccattgaagaaatttcgggagatctgcaagtccagggaaacaatcccaaaagttgtatggcggggcattgagaaggaacagaaattgggcctttgtaacgtttttcattgcgttcccgcccgcctctggcttcttaccaaaggtgatgcgatagatcacagagttggcatagcgagcattgtgggcgaaccactcctgcggctttcggaggtagctagccaagaggaccatgctctcctctttctgatactctggatacttggtcattgctgtcccgctgagcaattggtgcatgacccgtcgcctttcagcccatccatctactggcagcatgacagagcgccgaccttggctgatgagatcgctgaccatgggcatcggaggtcgcccattggtgacctttccatgcttgacatacagctcctgagctagtcggttgctgttcaacactacccacagcttggagcccagatgtgttgttaccatctcagcgtatttcgcgatttcgtgggcctgccatggaagaggaagggcaaaagtacttggggttcttgctctaactaattcgtccagttacctactcagccgtttatacagctcgctaccaattgcctagctcaagagcctcttccaatggtaaacttgcattcctttcccgatacgctagaatatctctagggtagctgtggcaatggcatggctgagacaagtttcaacttgcggagatggtcaggctgctgtagggtaaggtacctcgacaatagcacgccccgcagcaactattgccgatcagcggaggcgcccacggcatagttgcggaagcggcactaactaggtgcgcaagagcacgcgggatccagtcaataataacagctgctaggggcatgcatagtcttaaaggagggtctgagttggagtgcgattgcctgagtgcccttaaggtcttcgctggtccccgttattctcattgactctcttgttctactagtaaatgatactgtggatgaacccgctgttccgaaaatctatacctatctgtacttccggacctcgaagctaggagtcctcaagatgactgaagagtttaagcatcccacgataggctttattcgcggcctggccaaagacggtctcctgcagtttcttggcgtcaagtatgcgttgttgcaagaccgttttgccgagccggagctcgtctctgaatatgacggtagcactattgacgcgaccaaagtcgggtgagccatcctttcctcaaagaagcatgtcagatactgataatattccaagtcctcaagctttgtctgacccgttgtcgtgtgaagcggaatacagtgttttccaacagtcacttccacaccagccctttgatatctcggatcgagattgtctgcatctaaccattactattccaagagaggccaaagatcttccagtatttatatttattcacggcggtagctttactattggctccaatgcgtggccccagtacgatcaaactaggctggtcaggcaaggtgttgaaatggggatgccttttattggagttggtgtcaagtaagtctatcctctagatgcgtccccgtccgtttctgacctctactcagctaccgcgttggtgtgccaggtttcctgacgtcggcggagcttcggagggcaggctataagccaaataatggcatccgggaccagagggctgctctgatgtgggtgcaaagatttatctcgggtttcggaggggatcccaataaggtcaccttggcagggcagagcgcgggtgctggtaagtgtgatcgacatgcctcaaactcagctttctgattgattggacagtttcggcaatgctacacttggcgccgagcgcatccttattctctcagttggtgcttatgtcgggctcctcctttgtgatatcgcctctgccactaccagtcgcagaaggagtttacanttcatccaggcccttgcagatcttacggaacagcagtcggatagtcgggtccacctccttctcacatataaagtcccgtatcaagccgcgaagctcgtgacttcctttcggagtggttatcgcgatctctttcctcttcattccggctactggcgtagtcggcggcgttgagggacgagtttgaaaggtatattgaggagaaaccacatacgggttcagcaaggggatcgcgatgttaactggccacattccagccgcttttcaacctgcaatatattagaaactgttaaggctgcttgcctagccaggtaataacacttgagaaacgtcatcttcccgatccgcgatgaatccgtctgtatttgttgttgcgagagataaagacgataggctctcttgagggcggaaaagatagataagtcaagtggctgtaaaacgtgcgatgaatgcgatggaaggaatagaagccagatatgatttttaaagcattcccacatgaattcaacagtttcatgactcttgtggccctcaacaatgagtaaacgccaactgggcgttgcgggtttagttgacgggataaacacatctttcaaccattccaatgcgattgaattagaagtccaccccttctcagaagctgtgaaatgccactccttgagatgatccaattcatcagggaaccattgctgttgaaccgttttccctttgagaataacaagagaataaggtgccgacccgttgcactgatacactcaattattgaagtccaatagcgagatccgggctgtatctgggcagcccaatgtttgcgagatgatccgagaaccaggccattatctccaattccttccataatgccggcttcatccatattccaacgattgcaaggagggatcttgcgaatgtcaggaatgtgcttgagcgcaaagaactcctttactttatcagctgtagccccctcaacgcgaaggaagtcaattctcttgcctcgaagagttctaacctccgggttacggcgtaaaaatccctctatccaatgcctgccgacgggttcaagatcaccctcttcgcacaagaggaaccccacgatctccttgacccttgcatgactcggagggaagccaattgagtcttggatgagtatccatttcgttaaacgggctccctggatcctcgagagccgctgccgggtctctgcttctatcgcccgcgttttccgacccggaattccccagcgctccgcagcttttcgctgcgaaacacctgattccacatcacggatagccagctgaaggttattttcggaatattcagacattggcgattcgaatgatattattttcaattgaaaggaacgaaaattacacgagcaattgcggagtgacgcgtaaggaaaagaggaaggttgggactgaaaaagtgggcgattgagggggggcgattgactagggtggcgacttaaatgcttgacccaatgaagcaaaagtaaaagcaagctccattcatgctttttggggttgggctataactgtcaccatgatttcatttgaagcaaatcagctcatggtaaacaatgccttagcttatgtgagaaaaataagaaaaagaaacttcaaatttaatggcgcaagcaatacgaagttttgatatctctcaatgctgaatcgctctagtttattccataaattcgatggccttgaggcctatgttctttttccaaaggtgagtgagcaaggaactttgaccttaactgagatggccgtaaagttgcaggatcgtccttgccgcggggcccgtcaaagccattccggccaccggctggagtgttgtgctctttttgtggctgttcggaatcttgttctcgctggtgatgatgttttaagtatgctggaagacgggcaagtcacgcgtgttactaatgtgacctagcatcctttaggtacacgccgaggtccccgatggaaagtgtcgctgcaggcatagacaagattaagaataggatttgggacaatacgtaaacttatcttcgcacaatacagtagctgtggattctttgggatagagggacaatacattcaacatgattgacaaacagacactactgtatattctatgggcagataattggaccctacttgtacagcatggcctctgcagaaagaagggctataatacctaatccgggggtggcttggtactgggatcatatttcattttattcggcgtcagctccaccaaagggatttccacatttgagtggtgctcatgagctatgcatacgtagtatgacttattacggagaacgttttagtcgcgacttacatatgtagctcaagttgccaacgacaacagtagcatctatcaagggtagttctcgctcggaccttggtcccttggcttggcctttgcaataaatggtggctgtggatcttttcaagggccattacggcacactggctgcaaatggcaatatgctcatcgctcaacccctctctcggtagcgaaggataccaacactgccgattcatgattccgacactcagtttggcatctagtcttgaatcctgctagccagacttcgaggagaaaactcttgcgtagacgactatgatcccctgccaatacgtgtgtgtggacatctcggaagaataaccaatcatgccggtttcagctcgtaccgctttagtcttgtagttcatccggtgcaatatccgctagcgcagacacataagaaaacaaaaccaatgaaaaagcagcctcttctcacagtatatttgaaacacagaaaaacataggtacctgctccatagtcatatcaattcacagaatatactcctatatcacattagatattaagtactagcttcatagtttaaacagagaggtggtataactatatattactatatttgttatttcttcaacttcaatcattccacaaataacgttattctttattttaatttacttaaagaattttctagtaaattattgtctcttacaaaagatattctaatagcattagaacctattaggtccttgtttatatatgctcttcaacgtgcgtgataagcaaatgctccagataagcaagtgctccgaaaatccctcaacctacattatcaccattcaattaaatatttcccaacaacccaatatgtcacagtcttcaaatgaagctaaggttattcttgcccttcaggccctcgagaatgacctaaaattaagtcttcgaaaggccgcaactatatatcaagttgaccgctttgccttacgtcgccgtcaatccggcattcaatcgcgacgcgatactatccaaaagacaaggcgactatctgatcaggaagagcagatagtagtccaattcgttttagacctagattcgcgaggatttccctcgcgactgtcatatgtggaagatatagctaattctctacttgctaaccgcgacgcgccacccgtcggcaagcgctgggctcataacttcatcaagcggcaacaagagctaaagacacgtaaatctcggagatacgactatcagagagccaaatgcgaagatcctacgattattcgtagctgatttcggcttgtggataatacaattgtgaaatacagtatccgatcagatgatatctggaactttgatgagaccggctttatgatgggcatgattgagcctggaacagtcgtcacaagctcgcacaggcaaggaagaccaaaacaagtacagcctggaaatcgtgaatggataactgcaattgaggggattaatgcggaaggtcaatcgatcccaccgttcatcattggtgcaggccaatatcaccttgccaattggtaccaagaatgcgatctccccggcgattgggttattgcattgagcgaaaatgaatggaccaacaaccagctaggtcttgactggctaaagcactttgatcggtctacatctaagcgatcagttggtcgctatcgcctcttgatccttgatggtcatgaaagtcatcactccgtcgaggttgaggaatattgcaaggaaaacaagattatcacactctgtatgcctgctcatgcatctcatctacttcagcctcttgatgtagggtgctttgggccgctgaaaagggcatacagtcgagaaatagagcgtctgatgagatgctctataaaccacatcgccaagaccgagttctttcctgcctttcatgccgcccaccgagctgctattacagaaagcaatatcaagggaggcttcacaggagctgggcttgctccctttaacccagaaaatatcatctcgaagcttgatgtgcaactacagacccctacgcctcccgaggagggttgttgaaccttcgacctcttggacttcaaggaccccaaagacaatactagagacccaatctcactctatgtatctacaagaaaggattagaaaccataagagcagctcccctgagtctattattcaaagccgtaaagtattttgaaaaaggacagagcatccttctacataggatagccttgctagaggataggaatcgacatcttgaacaacaaaatcaggcagtagggcgacgccgaagggggaaaaggactagcgtacagaaaggaggaccttcgactgtagagaaggcatcacaagtaatcgatcagatggatgttgatacgcaggtaatggccgaatcctcaagaagtggccgtcgagcaaggtcagagtgaccatgtgctcggcattgtagcaaatgcggtaaggccgggcataatgcaagaacctgtcaagaggtatttgaggttaatagggaagagtatagtgattaattttaattgatcagatagattgtggtgtttttattacccttttaaagtctctaggtatagattagtggagcacttgcttgtctggagcacttacttatcacgcacgttatttatactttataaaaagtttttttcttaaataattaagtcacctcaagaatattaaccaatctgtatattagaatactctcaatggctagtgtctaattttgtccttcttgtactttctcaaaatcgatctgaagtgagcaactaagcccgctcttagaagccagtatggctgtaaattgcaaagtcgctcttgtagagcatgtaacatgaacggcacagctgtgccaccggcgctcttcgcagcactctgcaacaccatccgcgccatgtctttactacgcgttgtcatgaggtttgtgcccactcgatgaccgtcgctttccgtctcgcccatgatgcttgccacaaactcgaacgtgagcatcttcggccgaaagttctgtatccaatgccctgctataagcacgcacgtacgctttcgttcctgagtagacgctcgagtatggaaggccaatatccgccagtgaaccagcatttataatgaagctggggtcttcggcagctgcattcctctttagcagaggcagaagagcgtgtgtaaagtatgtcatgaacaggacattgacatttatgatattttggacttcctgaaacgattgttgctcgtattgctttaattcttcaggggcgtgacctgttcccacgttattaaccactactttgatgttaagctgcttcagaaaggccagcttctcgcgcgtaagggcagccgactctatattgaatgctatagcggcatcgaggagtagtggttccgctttaactccgtagtctactcgcagaagttcgcagagttcatcgagccttgatgtgttacgtccatggacaatcacattgaagcctcgaatgcagagctcttgagtaatgtcccgaccaatacctcttgttgcaccagtcacaagagcccatgtcccggctgtagaattagtgccgccatgaggcaaatcaaggatgtttgaatgagttgaaaaaaagcccatgctgatgtttgggaagtagccagaatacgacgtgcaaagaggtacgaggccagcacgcgggacagaagactaagtgagccgagcgaccgcttcgttgcagtgagaagacgagtgattgtttggccgaagagagtggcaagcttcttctcaagctcttgggatctagaaacactctttaaagaggtttaaagcccaggcagtaagccctttgggagagtccaagccgagtccttaaagccgtgaccagtatgtgagggagattcgacttggcatgtacaaggggatagactggtgaaagtttgtgtacggctaatatggttcgagcggaaccgaaagcaccatattcaggatagctcaaagaactttgaatcttgccttcgcatcttagaaccaatcacaatccagcatatctcgcatttaaagctaatgactactcagcactaatttaaatacgatcttggcaccatctccacaaatctaaatttaccattcccactgtatggaagttaaactctggatgagagctgcaaacccagtttatagctttttcacaaacgttctcaactcttgagttgtacatcaacatcctttctatctttccttagcgccatcctcattctcacttatggcggcggcctacggagccgcggcctggcgttgctcgtagacaagccggttctaggagaaaaagaggtataggcacacggtggggttgtccgactttgcaatgtacctttgtaatatcttaaatactgggacttcattggatcagatctatgtatggtacgctcttacctaagccctggaacttgcaagggtaagtccgcctcggattattggatccacttaacaaggataacaattatttagtctcctcggttgaattagaatcatttgttataactaccttatatcgttgatagacagaaccaggttagtggctagaattgggaaagattagaatgccttaataaatagccttgaaatactcagcttacgatctccacccatttcttcattatcagtcgaagcactaagaaagcttaccacccatcataaaattttactgccatttacaaataaacctcacttctcctgccagcatcgaccgcgcaagtcaaaaaacgcgacatgacgacaaaaccatcaagcgctccttgggctgatgagccgttccatctgattcctatgccggcaaagcacttagatgtatgcttccaaacaagaacaaagcagcttgtaccggctaacgagtacccagaactctctaggtcatgtgcatgccgcaactcagatgtcacaagcacacaacgtgatcattcgaggactcaacgccattatccagcaggccccacatgtgcctattgccactgatgaaggatacaatgcccaagatgtcaaggacctgttattttacgttcagtcgtggatcaaaatggtaaaccaccatcattgggtggaagaatccttcatctttcctgaaattgaaaaattcagtggcatagcaggcatcatggatgacccgaaaaaccagcacgagctattccataatggtatgggggagctgctaacatacgcggggacaaccaagccggtagattaccggtggaaggggcctaagggcctggaggttttaatcaactcgttcagcaagcatctcaccgaccacctccatgccgaaattgacgtctttcttggcatgaagcacctggatagctccgggttgctagaaacttgggaaagcgctgagaggattgctcataaatctggtaaacttgcgatgctggtaagagccaagcacctctattcattgttcgagtgctgtacccatgctgaacctttccacgcatcatagtacgacgtattccctctagtattgggatgctctgacaagacgttcgatggagggaacaatttccctcctttgcccttcatcatgacctatgcgattaagtgttggtttgctgcgggcaacggagcttggcgcttcaatccgtgtgactggtgggggaaaccacagccgcttgcctttgtcccagtaaagggaccttagaggctcaactcatgcggagaatgcataaaagaataatgaagctttgtgtaacgtatgtgataagaagcccgaccaaaaattctcacctcttcactttctaatcccttctagtatattatagaccatttgattaaataaaactacacactatactcgtccccggaggtctccatcactacctgacaggtcctcgcattatgcccggcctttccgcatataccacaacgccgaacacctggtcgcgccgaccttccttggccaccacttttcgacgattcggccgctacttgcatatcaacatccatctgatcaattacttgcgatgcttgctccactgtcattgggtctcctttccgtagtctagtcctttttgctcttcggcgccggcttagtatctgatttgcctgttcaagatctttgaccctggccttgagtaatgcattctcgtgcattattgccttagttccctttgaaagagacttcagggctcctaggattgaccctggagagctactcttatgtagtctgattcgtttatcgaggtattccgactgagactgggcctcaagtactgtcttgggcgtctttgaaacccatggtgtcgaaggttcagcagcatcaaggaccagaagacgatggcaaggaccagaagacgatggcgactatttgatcgcttacttgtagatcgatcaaagtgcttaagccattcgagacccagctgttatctgtccagccatttgggctcgttgcaataacccaatcacccggaaggtcgcattcccggtaccaattagcaaggtgatattggcctgaacctataacgaacggcgccatcgattgaccttccgtattgatcgcctggattactgtaatccattcacggtttccgggctgcactgattttggtcttccttgtctttctgaaccggtgacgaccattccggccataataatgcccatcatgaagccagtctcatcgaagttccagatatcatctgatcggataccgtacttcgcgattgtgttaggtacaagcgtaaaccacttccggatcacagttggatcttcgcacttggctctctgatagtcgtatttacgcgaaaaatgcgtcttaagctctctctggttgtcgcttaacaaagttatgagcccaacgcttgccgacagatgacctatcgcggtcggctagcaggtgattggccatttcttcaacaaatcgcagtcggggagggaatcctcgcgaatctaggtcaagaatgaattaaactatgatctgttcttccagatcagatagtttccgtgactttgggataatatcacgttgtgattgagtgccattcttgcgatcgcgtagagtactatagctaacttggtaggcttttgcagttggtcgcagctttcggcgtgggttattttgaagggcttgaagtgcgagaagaattctagcttcattagatgattgtgacatgatagtggttgagaattatttcatcagatagtgataatgaaggttgagggattttttggtcgggccacttgtccggtcgggccacttatcacatacgttacttgaatctatataaacttaacttttttctttagatcttaccctcttatttattaataatatccagctatttagatgtgtgacgtgctgggctctgagggctacagggtagtccaaagtgcttgattttttttatatgtcagggagatcgtatgacgaagttcgtcacgtaatcgctagtacagagttggagaatgtaggcaagagactattgtgttattgacaactagcgagtgtgtctatctgctgtagcgggtgactgtttatataattaactcataacagacgttccgtgccagatcccacagatcaggcacttcaataaactgtgatggagctttaagtattccagggcacttgcgtatgtttggtgcgataatcggtcagcatgaaaagacagggatcaatgtaacacttttcaggaaaccaagtccattttgcgaagagtgggaaatctagaatgaatttattcaagtagattagtatctcagtcccaaatcacaagagtaataagcatcaaagtctttacaaccatacggtgaaggtgtaccggtacgtagaggacagctcatcacgggtcaaagggatcacactcattaggcagtcttgacgattctctgagggtaactattcgaaagctacggtgagctataaataagaagcgatccaagcgagacgaagcccagtgcaatcgtgtatctgggcgattgtgcacgaacatgatttactgccaatggagtaatgttggactgcaggcacttcccacccaaaatgagaatcagagcatcccatgtcttcaagaatagaatatttgaaccgggttactggtttgtataaacgagaagctagtgaggaggtgatatagcctgatttacaggaaccccttatatgtctcttactgctgttagctggtgcttgggaatgtggtatatcggtgattgaacgtgtaagagtagtcctgattcatatgggagacgtaatttaccctaatgactaaacactatattaaaacctatatagctctatctagcacattcgacatagtttggtcgcgccatgcatcgatgctcaaaggtctctcctctcagccaagatactgttctgttgcaacagacttaagattgcctggttgatctcatcgacttgttcaaggaatccatgatggcctccttttagggggaagtgctgcacgtttttgaaggaagggagcgtactctcaaccactggtaacggagcacaagcgtcatccgtagccgagatcatgagcgatgggatccccaagatgaatttgtcgtgcggaagctctgctaatatgtcaatacatttataaccaacaaagatataatgatacctaccttgctcgaccttccatggcaggttctccatatagcattggtagtattgtgtagcggctttccagtcgtttgcgcagaactctgttcgttcctggtgttgatacatcagcaattgcgataagtgacatatgaacacagagagacaagcttaccaagtctgtgacgtattcgccaatttcgcatgtctgatcgctctcaagccacgccttcaaagctcctcggggcataaaacttttctaggttcaatcagacacatattgtttcgatgatgaagcacgttgtcatgagaagagttaggaatattgtacttgcagtccaaaattggggatccttggcgaagaaaagagaaaagaaagactccgtctagataacagataattatggtcagtgaaaaatccaaacctcaagttgcgagacttaacggggatctcacatgatcttctaaaagctttgtttcattgacaaacgtataccagtatccgaagatagaatggccaaacgcctgctccgtctgatcgttgactgcatcgaggtcaaacgagccaggcgggtagtatggcactgccatcaatacgagcgctagagtccgctccggatggaataaggcaaatcgactggctatttgggatccccagtcatggcctactacgactgtgtcctggattccctcatactggaggatatcagccaagctttgagctgaggtcttaggacagtaatcctcggggctatggggcttgtcggtctgacctaatcccagcatatcaggtacgacgcaaccaaagcctctagtttcaaagtaggcgacatgcttgcgccaaatattagccgtgtaaggaaatccatggatgaagagaatggttgtcttgtctggatgagcggatgagtagtagttgtaggtgtggccggtactggctctgaagtgcttgcgaggtgcggcatccattttgcttccggctgaggaataacgaactgttatgatgagggatgaagaaggcgagtcactaaggatatccgaaagtaaggggcattggctatttaaaggccaactgggagagatacccattgcgttgacccgatgtttccatctttagtgcaagcatttaacttggtaacgtaatccacaagtgagccgatcatacaagtgggccgatcacttctacctatccctcgtacaataaactcaattaaaataacaacaactaattatctaccataataatactagaaattaatttatcagattcctctccagcctccctacaggttcggatattatgaccaggctttccgcagttgccacatcgtggagtcttcgtacgagcctgccctccctggccaccacttctgcggttttcccctcttagctgctcatccacatccttctggtccaatagatctattccatcctgtatagttagggatcctccaagccgtacgcggctttttctagctcttcggcgcttgcttagtgcctcatttgccgtacgaagatcccggacctcagcatgcaaaagagccacctggtgcatcactgcagttgccccctttgtaaattgatccattgcagccagcatagaggttggagannnnnnnnnnnnnnnnnnnnnnnnnnnnnnnnnnnnnnnnnnnnnnnnnncagcatagaggttggagagctattttgatgagctgagattcgggatttaatatgctcagactgtgcgcttgcctcgtacgcagtctgtggcgtctttagaacccagggctgccttatctcaggtagggtctctggtggtgttggcgttcgcagcaccacatctagctttgaaagaaccctctctgggtcgtacggcattaggccggattcccattgccagaagcgctcaccacgacatccccaagccggatgtcatgcttgcgacttggtgcaccgccgccaatgccgaccattaagccgactctaacgttggggaaactgtggagcatgtctctcgcgacgctagcggcggacgatatgccgtactccccatgaggaaggacggcaatgacgatattgtgtttcccaatcttacccagtgtgtagtcattgttgtcgtttgtggacacaaattcaggcccttcgtgctcttcgtcgagaaaggcttgggcagcaacatactcagttgcaatcgcgcagatccagccgaccgtgtagtcatgggggttggacatagtcggcagttgtcttcagtgaggatctcttttgaacgcgaagtgaaggagctggggtgctcctcgtggattaaacccaaaacctcgacgtagcccggtttgttccgattaagcgccaaggcattaaacccgcttcttaggtagcaatgtgtcaacgtaaatgtctcgcaggaacaaccagcttggaagaagcgagggggcaaaccaacagtacgtcttcacttagtccgggggtcactctaacaaagcacaggctttccgagaagtagaagaatcaacgaagggatgaagacaagggttgagcaaatccacgagatctacgagatgctgagggttttatggctgcctaaccagccatgtgcggctgagcgcttacgttggccagctgatcatgcagagtgcctggaacttcaatatggatctgatgggcgtgaggcggttgcgggggcattgcggggtagaagatcaaccgaaagctaatggcgatacttatcagggaactagcgttctggggcaacattgggacaattattaaactgtgttcgatttctgaggcgtgcatctcgccgttaacgcggctacggcgggccatgtaggaagatatggcggatattcagaaattttgtatctataatactctccgactaaaaaggactttccactcagcctgttcgtttttcgttcattacaacacggaggcttcttccaaatacttcttgggagggttgcggcttcgatgggggcggttggaggattccgacacagaggctgtgggaggatccggcgcgtgggtgggcaagggtgccgaagcaactgtaggtgcatgcgttccggtaaaataaagcattgtataagcaaggataagggagcagttttcgggtagtcaagggaagtagcggatttagaaaagcaaagaaaaaggattgaatatatcagtcaacttccaacttccaatctttggggtttagtttcttaaaacagagggagtacagataaggagcgcaggagtcaccagcaaaatgaaatgagagagacgttggatgaccaataggaaagcaaaagataacggtagaaatctactaatttttaccaatcaccttgaagccacaagggaaaagcggggcccttcccaccaaccacagcgggagagcgggagaacgggagaacaaccgaaccaatcatatcagggtcttaagtcgagggtagagcacaggagaggcaagccggtcgcggtttgcgcaaaggagccttgaggaacgaagctggctatggctattttctgtttcttttatcgtctctgatcacagtcgccaaattcgaatcgtacgtgtagttaaaaaaaatttgttttcagtagactcccctagtaccctgcatttgcaaaattattcaattaattttatatagtaggcctacatagttaatgtcatataactgaagatggtcaatattcattgctatgggctgctaggaatggacatgaagcctctgttcgaaaattacttgaacaaggtatcagtgttgaggagaaggatagcgctggctatacagcgctcttgtgggccgccttgaaggggaatgaaactaccgtgcggctactacttgagaacagggcctatatcgaagcaaaggaagatgagtgtgctcggacgccactgtttttagcagctgggaatgagcatgaggctgttgtgcgactgttgcttaacatgggcgccgagacagaggagacggacccgggcacggcagcagtccctctcacctcccctcgcgggctcttcctccgagcctccgtcggcggcacattcgtacaccaactctcctatattgagcggtgccgagaacccgggcgcggggcctgctgccttggcgttccccactacaataccttcttttcctcacagtatctgcaccaaccgggggctggatcgctggataaaaatgcatgaacatacggagaaatgctgaaagggtcgggcctgtggagggcccgagtcggatccgcgtcagattaacagtcaaaatgtccaatggagttgaataactggtctaacccgtctcttgtcaataagccagaaacttgtcatggcatcgccagttatgatatattgttaatcgatatctctatgcgctttctttctaatttgaaccattaaatatcagcaggttggtcagtaagggggtgatgtaagtattcactaacttatctgtgtccaatatgcataagacaaatagtagattcacaagctaaggcctatgctaaaaacacagaaatacattcccaataccgtctaggatatttctgtgcatggtttgtttacttcctagtgcagcagcgtctggcgagtgtggtcctaagcctcttattcagcacgtagctcaagaagcagcctcgcgatatctttatgcccggtcgccttggcacaatccagcggcgtccggccaagattgtctttggcctccttattaccgcctttctcaataagcagcctcacggcatctgcatgcccagttatagcggcaaagaggagtggcgtttggccttcactgtccttggcctccttattagcgcctttctcaataagcagccttatgatatctgcattctcgtgaatggcggcaatatacagcggcgtccggccatcgccatccttagcctccatatcagcgcctttctcaataagcagcctcacagcatctgcatgcccagttatagcggcagagtgcagtggcgtttggccttcactgtccttggcctccttattagcgcctttctcaataagcagcctcacgacatctgcatgcccaatcacagcagcagagtgcagcggcgtccagccaagattatccttagcctccatatcagcgcctaactcaataagcagccttacggcatctgcatgcccagttatagcggcaaagaggagtggcgttcggccttcactgtccttggcctccttattagcgcctttcctaataagcagcctcacgatatctgtatgcccaatcacagcagcagagtgcagcggcacccggccaagattgtccttagcctccatatcagcgcctaactcaataagcagccttatgatatctgcattctcgtgaatggcggcaatatacagcggcgtccggccatcgctatccttagcctccatatcagcgcctaactcaataagcagcctcacgacatctgcatgcccaatcacagcagcagagtgcagcggcgtccggccaagattgtccttagcctcagcgcctaactcaataagcagcctcacgacatctgcatgcccaatcacagcagcagagtgcagcggcgtccggccaagattgtccttagcctccatatcagcacctaactcaataaacagccttacagcatctgcatgcccagttatagcggcaaaaaggagtggcgttcggcctttactgtccttggcctccttattagcgcctttctcaataagcagccttatgatatctgcattctcgtgaatggcggcaatatacagcggcgtctggccatcgccatccttagcctccatatcagcgcctttctcaataagcagcctcacgacatctgcatgcccaatcacagcagcagaatgcagcggcgcctggccaagattatccttagcctctatatcagcgcctaacttaataagcagcctcacgacatctgcatgcccaatcacagcagcagagtgcagcggcgtctggtcagtgtggtcctgagcctccttatcggcacctagctcaacaagcagcctcgcgacacgttcatgcccggtcgctgaggtaaagtgcagcggcgtctggtcagtgcggtccttagcctctaaattggcgtttttctcaacgagcagcctcacgacatttacgtgcccggctgcggcggcagagtgcagcggcgtctggccagtgtggtccttggcctccttatcagcgcccccctcaacaagcagcctcgcgacacgttcatgcccggtcgctgaggcaaagtgcagcggcgtctggctattgtcgtccttagcctcctttttggcgccctcctcgatgagccggctcgcgacgagttcggaggcggcaaagtgcagcggcgtctggccagcgcgggatttggcctccttgtcagcgcccaacccaacgagctgtgagactacttctgccattcccgctatcgctgctagatgcaaggcagtcctgccgttgtggtctcgcagctttttatttgcatcttgccatagatattcgacgatgccccgatgtcccttgtatgcagcccagagtagcggtgtgtttccagatgtgtccagaacgtcaagagctgctcctgcttcgatcaaccgtttgaccacttggagatggccattcattgttgcacagtgtagtggcgctaatccatctctgccgtgcacatcaagttctgcgccttcgcggatgaggttctgcacgattcgagccttgccggcctggcaggcgtaatgcagtggtgtccattcgagagtatttcgggcgtttacatcggctcggcgcttcagtagttcaacggcggtctctgtggatcccttcgctgcggcgtaatggaggggcgtccaattgtatatatccgttacattcacgtcctctccatctcgtaaagcccctttgatcgcttcggtatccttccagtcgctggattgagcgagtctgtgcagctccttgaagttgaacactttagagtaaattgtgtcttcagcagatccgagtcctacaaggtcgccattccagggacgaccctgtgcctcgtatagcctaatgaggctcgacaggatggcccggtcggcagtttccagcttctcatcaagcttcgatttcagctccttcaggtcccgtatatctctctcctcatattgttgcgccttcctcaattcgatgactgcagtgaccatcctcagatattccgtcaactcggccgtagccctcgtggcaatgcgactctgttcagggaatatctttactgtttgaaagagccacaaatatacgaggccggcctctgtccaatgccctagcttctcttgtcgcctcgcatgttctcgtgctaagtcaatgatcgtgtctgactgcagaagcttgtgctcaacactcagtggcgggatgatgctcaggtagacatcttctagatttccaaatccagtgctctgtatttcccgagccatcttcgacagagaatcaatccggagcgtaaaggatcgccaggcgtcaatgccgcgagtgtcattaggttgtatgtcggcgcccttgatgggatgcgtcagtgtcttcgccacagcccacataaaagccgagaacatgtcttgggcatataacaaattcaaggggatatgcgactcagtcgccaaaaatagattcctggcttctccctcaccaacgtgcttgtccaatttatcctttggtggggtcggtgatgacttccagatcctgtatccgacaggatgatgagttgcgctatagccggatccgacaaccctatgaggctccacttgaattctgctgctgtcatcgagctgtgtcgtcgtctgcacttctattactcgggccgcgccatcaggcataagcaactggaggtgtcgacggagcctctgcgtatatgagccaagaagtcgcaggctacgctttgcgggcgatcctttggcgcggaaccgcgcgtcgtcttcggaacgtggagttcccggagacacttgctgattctggccctgctcttgatcgctgacggaaaagagccacaacgatagcgctgcctcgatctcttccgcggatgctttccagcttccattttgttgtttcaaatgaaggctgactgactgggcgtttgattcggcagagtgggctttaagggaccacacaaagctagcagtgggagaagaggcaaatagagcattcatcgtgacctcgattgcccttgcaagggagatagcctctgcagatgcggggcctcgccaatcatacagctgcccaagatctatccttatcttcatgaccgtatacgccttcgatgtgccattcttgcttgtctgtcgcagtttctcatgtatctcaggacttccgccggtcatgatcccccagttgctgtttttgcagttcttaactttcgactcgggctctggggtatcccaccagggtgcattgttaagatcccccagctttatcgcaaaccattcaagctcgaatccccgagagaggggatggtatcgaggaggttccgctagcccacgacgaacccacgctctgaggccagtcattacgaggactgccccaagttgagcgaccgaggcagaccagtgcatcccgcgcaagccgataaactgcacgacgaacccgcagagaccgactaccgcgccgaggacagttttcaatgctaaaatggtaccttgacgactttcttcgggcactcggtgggacgtcataatgagagctcgcttatccgaggcaaataccgcaaaagaattgaagacctggtcgctcacagtttcggccctctgcagccaaaccattcggatttccttcccccgccctggtttatatcgcttctcttcggtgctgctctcaacaacatgggaacatatcaacatcccagccaccaacgtaagtgtcccggctgcagtgcagggaaacgcataatctgcaacggggcctccgtccttggcaagtctcagtgatgggtagtaggtggcgaacccagaatacgtgaggacccccagctgtaggatggtcccgatgaccgcaaccacaagtaattctcctcttcctagctggttgtgggaattgagcgcaatgtttggcgcatcggccaccatattccttgcgatgataatctggggcgccgaaggatcgcgtgttccttgcccttgctccgcattcaagtcaccgggagagtgtttccgatgaatcatgcgtttgatgccgtcccagaggttcgtctctgatgaagaggtgagtatgagtctgctggaggagaatgagattactaaccaaactcctcaagataacccctttccaccgctttacccacgctgacagtccctactgttgtatcgacgggtcgaccattcccagtgctcggcgtatccgtggatatcaagcatataaactcagataccggggataatcccatacatcttaccacctcgtggccattccagacctcacagacttctttcgatgtggatgacatcagttccgcttcggcgacggcgaggttctccctggatcttccgatgatggctctgagccatgaagggccactgactctgatggcactgacaataacagtgattatgcctaggggagccattgccagtatgaagttgtccgcccagcccatcgactggctcataaattgcatgatgactcgttctccgaagagcgccagcagcctgaacccaaatgaccgtcagcaaataggctagaacggggggagggtaactcgtacggggccagatctgagaataaattgtttgagaagtcatctccagaatcagcagcggcacatcccgcgaaggatagcgccaggaggaatctccggttctcagcaaccgacatgctgccagtcgaagacgggaaatgggtgggtagatcgaatctttacgatggaagtatactgcttcagggtaaataagacagtagatgcctcggcaatagtttcggatgtaaggatgctgagtctcgagaatcactttcggcgctgcgatggcgtgatacacacaaaaccttatagtgcaggagaaacgagaggctcctatccgatggacagcttaagggcagttggacaacgccaggacaaatactgatcactaagccaatatgcagtctttcaacttttagcactacttgcatagtaactggcctattaggttcacgctgccgaagatcccgacccctttgtgtatattttcttttgcacgcaataatgcaacaaaaccggtggccggggcttacgccaatgcaccaggtctgtccacagagctctcttgcccaattaatcccaggttttgtgattagctatgacaagcccacagagttgtcaattttcagcagccaagccaaacccttctagactgcctacatcagaactcaccctatccgagcgacttgcagcgcccgtggatgccacgtccagcggcagtcctaccttatagaactcagcgagtctcaactggtggctgctgttggttacattctcgagcaccgtcccccgtgacgcagcatactgtggggtcttacctgtcaagtatccacaacgtagtaagatggaaaccaaaatattgacgggctagtgatgcaagactctcatagaggcgagggtttcactcgaattgacggcgacatttcctgtggtgcttaggccgaatcgtgctagccgattgcacggagcgagagccagacctgccacgaattcatgcatatgcaatgcaggtcgccaccaataagaacagcttgatcaaggaggcggtgtgatggcctttgcaccccaggtgaccgcggccgctattcgagcttcacgcagtgcaactggtgttggttcgcctattgcaaaatggcggttagcggatgggtttctcgggtggaccgtaagcacagccccgtattgaaagctagtgtttaagataccgtcatctgctgatatagtcggatctcgctcggtcacgcaaaatgaccgccaagcggacattggccaagctgagactggcgacggctagtgagaggagagtgaagaacaaaatcgtaaggcgacacaggatatgtgtttggaacgaggcggaaggtagaaggtgtggcaaagctgaaagcttattgatgttggtaaatgtgctgtagagtgcgagtgagttgtgaattgtgggtggaggaaattgaagattccaggcaagggccaacgaggtgcagtccttccttcaagatcattggcttatccagggcctggtgcgcatcccaattcagctggacgcgttttgctacacctgggaagacttcgattcgggaaccgtgcccaacactacgactggcgtatacaaagctattgtgcaaagattgtggaagaaggatgccttacgattggagaaaaagtccgggggctatatcggatcggctcgtccaaccgagatcaagtgcagtatcaagtttgagaaggcgcttcttgaatgtttcgcatttagcgggttatataatgatatattagacttccgctggcgcatcgagacgagatagccaaaacattctcacttccgggagatttctcgctcaatgacacacttgcgcaactctctttcctgcgaacgtcagacttatcactaaaagacaaggaccgaaattaccattttctgcacctgacctttcaggagtacttcgcggcgcaaacaaaagttgaattcactaagtgaggagacgattggaagatcttcggggtggatagacgggatgggctcagtgtgagtactgagtataatacgtaaagaacgctttagatagcttacgaaaggatagactcttgcagacttcaatattctaaatatatagatatagacagctataaatatagttaataaggtggaggagaaggcgtaatgggaatatgtgcaaaatcatatcgggggttataggtagaaggaaaaggaagagggaaagtttaaaaaaaaaaaaaaaaaaaaaagccaagggaaaaagggaccaatagaacaagagtcgtatatatatcgatatcgtcgattaaagaccaatcaaagggcagattgttaagctgaccaataagaggtgggcaaggtcagggtgaagtttcagcggcgcagaagacctctcgtctcttcgttcctcaaggcatcagagagcgaaaccagccaccaatcagagcgaagcgcttaagtccagggccaacagcataagacctctcgtctcttcgttcctcaaggcaagaaagacctctcgtcacttcgttcctcaaggcaaatacccgtccagggagctacaacacttcatccgttgtcccttgactcttgatcttgggcttgtattgatacatactacagtggttatcagtgccttaattcatgattagattgactgctgctagaggcaattccgtcttcagattagcttctaaatggcgcgctttctatgctatagacagtttcaggtctggtcggagtttcgagactcgcggtgctaacggtaagagcagcatgacaaaaactagggatgcgctccccctgatgggaagtcggaacccgcgagaccagcgccgctgagaccttcggaggagcgctgcttgcgaagctcctcgcctgccggaattttgttactggatgtgcgagtgcggtagtagagagccgtgccgatggcggctgtagcgacgaaggggatcgcaaggcgaatagggctaggtttggtggatcttggattgatcatgatgttttacttctgtgagcacctagttattcggtttctttttctacaaattgaggcagagtgactttcagcaatggtatgatgtcccggcatatatattctcggaaaagaatgacccgcttcttcttcgatccccagtcatgacgagctcgacatcaatgatggtgatgacagcttgatctgtggtaataccgtaagccaccaggcttaattttaaagcttccataatgctcctggggcactggaataattattattagcttgcgaaaaattctctgctctacaatgagcgctgtgggtcatcaaaaattccatgatttcatagttgatggtatcagaacagtccatgattcaatgactcgtcctggtacagactttactaaatgcatacataccatcgccaattagtgtctctggcgtcaattgtaatattaatttgatggatttaagcatggaatagtggatctcgagtcttagcctctactgtgtcgtattatgaaaccttcttggctgctaattaccaccgtcgagctcagcctcggttggctatttcaccataccgcctggttcgaggccaatgcacgacaccctctcagaagaccaaattccagttctagattttcttgtctcaggagttcttaaactagttatgcatgagaatccaagggtgttgttggatttcttccagagataaccgtttggtagggtccacaatgagaatctgcttttttgtcagccactactcgatgttgatgaatcaagaatgaagcattaccttgtgaatcaagtctgtcgcttccggactgacagatgagggaacttccatatctaggctcttgatccttttctgtgtcatcatcacgttatcctcgaatggcgctcttccaacaagtaattcgaaagtcataactcctagacaccagacgtctaccattgtatcgtaggtctcagcgcccgtcaatagttcgggagcaaggtaatccagcaatccgcacaaccccgaggaacgaccatctaccataggcttgctccagatgaagcctgatactttgatctctccatccgctccgataagaacgttttcagggttaatatccctatgaataatattcttgccgtggatgtatgtgagtgcctgtgctaactgtgcaatgagcttagcagcctggggctcaggaaccttggtattcttctgcgcgagatcatacagactgccctccctggatagctccatgaggacatatatcttgctgtcatcttcaaaatttccaaacaccttgagcacatttgggtgatccatctcgctctggatcttgatgctgccgcgagcttgctcttcgactttgccgtaatgcagatcggtctttttcatcgtctttagggcgtactcgagctctgtctcacgatccttggcatgataaacccgagcaaactttcccttgcccagtttcttttcatcaatttcaaacatatccaaattcagaaccttgttgaatatctggctgggttcagaagtggagggtgggctatggtcttccatctggctggcctcctgcaccgaggtgttctcagataatgccatgttgtccggtgtcttattatttgataccgcgctcggtgttgtaaatgatgaagcaaaattgaataatcgaagatgttttatagaagccagaaaagattcacgtaagcatacccaggggtgcatgcggggtgcctgcattcacgtttcagcaccaacaacaaagtcacacacgtgaactccttcatacagggtgcgtaatatcagaggagccatgcacgctttacaattattcccgcgaattaggaagtccagcgtagagtggcccgagctccaacttaaggatcgggtccacatcctggcggaactctgatgagttcaccaggccgctcgtgttctgactcaacggcgtttgttggattgacgaaggtattggccggggaggaggggtggattccgtgacagcgtcgtagagatgtttccagatgagggcatcgtctagctcatcagcgagcgcggattttaacaagggtttgacgcggtcaacatcgaactaatcggaggcaacagcagaaatgagtttaaggagatcgtttcggaggaggccgtggcctgtctttgattgcagtaagagaatgacggggagttttcgcagaaaggaaaggagatcgagagcgagattctggatatctgcgacctagttaggggagtagaccgcagcgaagtttatttatcttaccttcatgggtaaagtgggcaagcggatcaggcgagtgaaagatggttctgtctttgcagagggaggtgaaagaatcgcgaaaaacgtcgagattgcttccaataggatggtcctcaatcaatctggactggccttggtacgccatggcgctgtcacaggcctgttgtgtagcacgagatgcacagagccgtgttgagtgggtgtgactttgtcacacccagccccttttcgggattatttcggaacggccgtcgtcgaccacattcctcgcaggcagtcgattagtcatactgtaccccgtcccgcgttctccaatcacataggtgaattccagggcttacagtaacccatacttgattggtgtgaaaacatgccgtaattaatttagatccactaaggccacaatcgtggctcgttgtgttttgattgtttgagcttttgcagctgcatgggattatgttactccccgatcttcccaacgagattctggccttgatcggccgttatcttctggccgaatctctgtgcgcattaactctcacatgccgccatttgtttctggtctaccagcccgagctggtacgttcaaacgccaaggcgcttgcatggggctggaccccgctctccttagcagcaaggcatggacatcatgctatcgtggaactgctcctctccgaccccagagaagatcccgatcaacgtgataaagagggcgagacggcactcttttgggcagcgagatgtggtcaagcgcctatactgaggcggcttctcgccacaaaccgcgtcaatccgactagacagaatcaccaagaccaaactccgctgtacggcgcggcatctagaggacagactttgacaacgcgattattgcttgatacaccgggcatcgagccgaaccccagcaacgaatcgggtcgaactccattgtggattgcggcggcacagggacacgtttcgactgtcgagtgccttctagcagttccagcaatcgacatcaaccgttcagacgattccggaagttctccgctcctagcagcggcaagttacggacgcgaagaagtgatggctatcctagcaaaggagatacaggtagatctacgggccagggacaaccatggcaggacagcattagcgagggctgctgggaagggtcacatacgcgtagtgcgtcagctcctcaatatgggccagttcgatttgggatctagggacttggaaggctggaccccacttgcccatgctacttggtatgggcatactgccgtcgtgtcttttctcgctgatctggaaggtgtggatatcaatagccgagatcacttggggcggacgccgttattcctggctatacgtaatgggcagtacgaagtagttaattatctttgcaatagagcagacgtggagcaggatgttaccgattctaccggaaagacgttacgaatggcggcccaggacaacgaagaccggataatgctcgcattactaggatcctttggcttacggatagacgagccactaccgctcacgctcaaggacgttttgcacattgttggcttcgttattgcgttgatagctatgttggcgggtaagttcctgagctaggcatcaggagcggccgctccgcgctacctcagaggagctactgtggagtcatcgtcgtgatgattgttcatttgggggcaaatttgatcagtgtaagaacggtaccattgtttacttaatacttctccatacaagtctatacacgtattgctatgtttaattcatagtactgcatagaatctgtggcagcttgacttgttggctgtactcgatggctgtgtgcctccaccccatcatgcgtgctaatatcaggggtttgggagcagtatgggcaactgctatggatcagactggcaagcgcaccattcactattccttcatcctctcattctaattacgttccagaaacactatcggtctgcttcgtcctacaacttctactcttccatcatcaattgaaagtgcttacgggatgctgggtgaagcactttctgtctaggtgaggcaggagaaggctaagtagtaagccatcggttggcacctcgcctccagagcgtcgttcgtcggtcggagggggtgttaacgggtaacaaacctactgcagaggtgtcgttccattcagacttgatttgtcgcagccgagcgaactattccggggaaaaattcatcatgtctttggtcaagttgaattgcagacatgtagcttcgtgagacttgctgcatctacccggctgccaggtgagtcctggctggtggccgtgtttcaggacattgcgtgctcaattgccgtcctcgtctcgtcaagcccctgctgtgctatacgctgccctgcacgttgcccaaattccattcctatcttctcaaggccatgttactgcagctgtttcccaattttgcttccccattctgttccattgctttcccgtggttaaatagtgttgttggcgaactagcttaaatgctattctccaagtgttcagtgccctatctacgacggctgaagccgatgtccgcgcttgtggcacagggtgttcggttgtggggtgtgggagcttaataaagattcattgatgtgctggccagcctttattttgggtctgggcatatgacaaatatattacagtcttgtgaccgctaagctactacagagaaagtttgtggccatccggtggcaactctgaaccagcatcagggtgcggatgtaacgacagccgccagttcctaggttgttgtgattacatcagcaccacactctgtctcggcttaacatcggctccgctctaccctcctctcagtatctgctgagctggttccccttaatattgttaccgacttccacttggcactgaattcacaccagattctggttcatcagagaggagaatgagctgcacgagatcaaagatcgaaacacacatatacgatacgattcccttcatcgctgacgcagcgcttttgcccagccctctccctaccaccgaagccattaccttgtctgaaaatgtcctccaggaatacccgggtcggcgcatcgttcgtattggagaccatttcatcatcaagtatggcgttggtgtgtcattaaatgagggccatacaatgcgttttatcaaacgacactcaacagtaccgatcccagaggtttacgccctatattctatcccaacagaggattttcaaaaaccaacaaattatattataatggagaatgtgtcgggggaaagccttcaatcctactagcatactcttgataatcaagcaaaaaggaagatcactgatcagctccgagctcactttatacaactacgccatatccctcaacagggctactttggtgtggttggaaaacggccatttgaggatggaatgttttgagatggcaacgatactgaccagaaaacctcttctggcccttttgaatcagagcaacaaatgatagaggctatcttatccaaatatcatctagcctatcctgagaaccaaaagtttgggttttatacgcgatatcttccggagattgctggagatagtatcccagttttcactcattcagactttcagcggaagaatgttatcattcgtaaggacggggctgtggtattaattgattgggaggcagctgggtggtatccagcattttgggagtatgctgttgctcattttgcctgtgattggagggacgattggtacatttggatctcacgagttctggatgagtatcctaaccattttatatggattgacacaatatttcgagagctttggtcctaagtttcatcataaatagccaccctcaaatattgcgacggccctaccctgaagtgaagacattggacaaaaaaaagtgaaaagaaaatggcaaaaaagttgcccatgctgctcccaaacccctgagattagcaagcatgatggagtggaggcacacagccatcatcgtgttggttcgcttggctcattaatcatgcgccgttcgatgtggtggagttgagtccgggtgcgagtcgcaagcataagtaggaccgagttcccttttcatcgtgtttccacaccaactctgacccatcttcacatattcttttaaccgttacttatttaccccttatgacattcttcgaaatcatggaccacatttctcaacatcagaccactgacggttatttgatagccagcctctccttaatttgtgtctgccttttcgtctccctcaagtttcgtcacccatggtcgcgggagatatagttcgtatatctaattaggggatggatcatgttagagctggtagctctgatcctcttctctctcgagtacagccaacaagtcaggctaccgcaaattctctcaagtgctatatatatcatattagcaatcatctccctgtggggagttgctatacttcaggtttgctgcagtctctgatgagctcaaaatttattctaacgaaataactacagatcattgcgattatttatacgttcacgatcataatcaataaagaagggtggtggaaatggctcatcattctggagtgcattgaagtcatcctcgctgtcatcctggtcacgataccgaatatgccagcaccccttgagcttgcttacatcacaccatttacctcgcaagttgctgcttttggggttttatttcttgcatcccgagggatgtcatctgagaaaaggatagccgatcacttgttgttcctaggcttgtttattatactggcatctgcaggcatccttggactttcgctggtcggttgctacacaaggctggtgttccctcaatggcttctctacatggccatattgactgtgagctaccggcttccggaaggtccacgccgagctcctcatatagatggagactcggagatcgagttagccgtccatggcatccatgacgacttaagttcgccacacgtgaatggtcaagaacgcattccttctagcgcatcactagttagagctcagacagccagctctgtcgcgcctacgatgagcagcaattgcgagcatgcaagaaagtatgtctaaatggccgtggtcaatcaacgaacgcaggatgcccggactcgtatttccaaatacctcgaaagacttggaagagctatttacagagggaagggaagtatatatataatggcagtgaaaggcaagtaagcggagcgtcgagggccaggtcgttcacatcacctctgtttactttacatgttgataggcaaatgattggtgggcatagaataagaagctcagctagttaatagtattgggggatcattagcgtacgttaatccagcaaaagcgaacctatagccatcattcaggtcctggtgtaatgtctgacgtgctattctaccaagggggagtcctcggacaaattcaaaggcagaggaacggagaaggggggatcgaactgcccaccgtggtcgaagcggctaacgacggtgtctggcgagagagagggggaagggtcaagtagattatggtagagaagcagctgacagaggggagggaaggactgcttgccaaatccgatcctggggcacgacctgcggccagtttctcctgcacatggccagtttcagcaagccgagccaacgatccctcctatgcctacgccccctcggcggccgccgtctggcaagagccaatgtctggaggggcacaggcaagtcaaccgtgagtgcacaaagatgatacccccctcacccacggtctgaaaaggggtcagcaggatgatgtatcccggccgctgttacaagcagtatgcaacgtaagatgagctgcctaggcaggcgtcgccagtcgtcagcctctggtcctttcagagagtagcgcgaggaggtctgtggcgaagacagctgaaagccagacggccaagagcacacaccccttttcctccggcggctcgagtacatgtagcaatgcgcggatcgactagacatccctctatcccagccacaatgtaccggatcccgagactgccaccaaccaggtgacaaacacgatgacgaaagacaggtgaggagagtcacagttctctgcctcaagagngaagtagacgtgggttttccgctagatgcgatctaactggtggtggtagtttgcggttaaagtagatagagaagactgataataagagagtcttctcttggcgcagctctatattggagagatgtagcattcgtctccagagtacaaaatcagttatttgagttatagaaaggttccaggctaagttagactccgtgtgaggaatgagtatttcagtgccatttagggagtgcctgatctccttgtcgatttctgttatgttttgtccacgaaagatgcggctcgatgcaagtttcaagtggaacgtcctggtattaagtcgctctgggtgatcacagaccaggactccaaaactctctgcaagaagatacaaattctgtagtggtgttcgattgcgagaaggctgcacatgactccgcacggaaggccacaaaactcggcgcaggagggcaattacctgaaggccatcctctgcagcactgtaatacggaagagactgcgctatttgtttgataacttcgttgtgatcgaagttctgtaagagtgattcggaatcactatctcccgcaacatacaaccccaggaacactgccctgcgagcagcctctgcaacgacatcagggcgcatggcatgaagttcatgagctaggattggactttcaacgcaagcagcaggctggggaagctgcttacgatacaaatccccaagatgacgatgtcgcgcgatctcagtggcggcgtgctccatatattgaacattcgttatttctgtgcgcggcgttccagcagataatgagggttcgtactgttgcccgagctgtacaccatcacagagcgaagctgggccgatttcggtggtagattgaggactcgccatctcggtggggagggtcatggcaataggtactaagaatggatccagttttccatggcgactgtaactgccatagtgggatgggatatcttgcgctggcgcagaggcggctgcctgtgaagggacaccatccgaccctcgtccctgatattttatatactcgttcaacaacggtaatggttgaggagctggcagtcctggggctgtggagtcatgatatggtagtgatatgtccgcagacttttgctgacattccgatgcttcaaaggtaggttgaacaggcaagagttgaaagccgtcagacctttgatagattggtgaggaagacatgtctggtgattggtataggatgcagttgccagaaaaaagtgtctcagtcaaacacttgtgcagtgggacaggcaaaaattctactttgctgggcgcatgagtgttctcttatagattgaaatgaacaggggcagatgacaaaaatagctccagctggcgtcagatgtctccagctgaaggctgggttccgggttttgagtaaaaggaacttggtcgtgttttgtgaagtcacaattttatgccctacttacaccataatgccataacgaaactatcgatagccgaacaaggatcctcaggctgcgaagcaacctcactggctagagggtgaggctttatccaaggctcctttacctctttgcctgcctttgttattccatcgtattttcctgttccgtcttaagcgattgggacaccactccttgaccaccttagcatatctgcattagaggcgttgacaaaattgaaaacatgccatcaactgtagtattcgagcggcttggtctaaatgaagaatttattcgggaccccataacaatgttcgagaatgagttgataaggaccaggtatagcccaccattcattccctggttatgtcatttctatagaacggagatgtctccggcatagtttccttgcgtatgcagtcgctacacttcgttagcacgtctgggttctccgggtcccttggttcttcgaccaaatcatgatctgcagaaggccctttgcatcccttgaacgcttctggacaccattcaatcgtaaagtatccaatatgtccacaatcccacttcttatctacctgaacacacatcagactaagtgaatcgagtgaagaatcggttgccgaatgcctctgattggcctttttgaataagcaaccttctgcgatgtggttgaaggatcagaactcacctcagtatgattcaacttggttgaaagtttgaacggtagtatttagagaaatagagggtacagcactttgaattggaatagaaattcagctacgggagcctatttgaggaagtgtctttggtcatggaatagacgacgatgttccaggcgtttagataggcaaggactatggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgctatcgagccttccaacccaaacagttgtaactgcggatcgaaagataccagtatcagcatcggtgctgaatcttctaattcgccgtttagatataatatatgtctgtcatccgctgcccaggccttgacagagccatcaccaaaaggattgagaataagaagggattttacctcctcataggatggccatgcatggatgtttccaccgctttcgccttgcctccctgacctcgatcgtaagtagagctgcggctgccgtgaagtatccgaacttctgataagatcaacaaagcatccactcaagaaattgtaccaacggatgggtgtattcgtagacgttgagacacgacctgttaaaccctgatccccgatatgaaccgttacggtctcgtccttcgtaaatttgtatccaggggggctaatttctttttggtagcagaatctttggctatagccagcagccgtgacttcctttcctgtttccttgatgaatatcttgccagtgctttcgcattgcaccaggtcaatggtagaccagctattgtcaatggaactaccattcctaactatcctctgcaatggagcctcggggagaatttggtcggaaggatggttgcctattcgaaagcgaaacatcgagtagaatgaactttgcgggccattgacgggaattgttgaaacaccgtaaaaataatcgtcaataattttaaaggtcgtgtcctgtcctacttcactaccaaaaatctctggtaggaaaaagggtgaggacacccgccctgatgtaatatggagttgtcgtacactccattgttcattgttcactccatcaacaatgacaccaaaatagaggtagtcctcggtatttctcacaaagattcgacgagtggacaccagctcgcataatcggaccacctcccgctcagcatggcatgagataagccagtattgtgtgttctcgcccctgacttgtaataagcaagagacaaagccacacgcatagtgcaacagtctgactccctccaatataaacccatctaaatgagtagcttggagcattctttgcagatcgatagctatctcttctgtgacagatccttgaagacggagagttcgtatagattgcccaacacaatacaccacgacgctatcgttgtagataaagctagtgcaaacagcaatcgcagacagcaaccatggacgagctgtcttcactgcaatagtccgctttataagagacctccaagctctagcgtctgaacccgggttgacggagaatggtgcataggtctagattggttagtgaaagttgtacccaatagaaattgtcaccgaccaaaagattctgccgacatatcttatcgtcaagaaagaaattaaggcgtttgcagcacatgcctaaatgaaattgatcctctatctcgaggaatcccataatacccaagaggatatcgctcggaagattcgagaattccatcttgagatgcgctctagggagatgagatttgacttccagaggttggcttgatcacatgcgccaggaaacggcccttggttgctgtagctcctgatatctagctatgaccagtattgtttgctaacaacagtagaagagcaccgtttctgggtctcaatatgatttgggcaccgtgattttatcagatagttgaagtgctcacagctgaattcctgctgtagtgtcagccctagtagcttgattgaagactggcgcgggtgactcacttaaatatagttgcacatgctagatgacagattctgaaaagggaggcaaataaaagaaagcacaaccacttcttatctacctgaacgcacatagactaaatgaaccgcgtgaagaatcggttaccgaaggcctctgatcggcctttttgactaagcaaccctcttccttaagtattagctcatcacccacttcgatcagtagaagagtctgactacctacgtatttcctttgacatttagcactcgttctgaattccttcacgtattgcatctaccttcttagctttatggatctgaaagtgcttgccaaggaggccaccgaccgggtagcgagcttcaacgacctcggcggccggatcgagaaccgtcaggctgagctggctgccagtgctgacaatggcgaaatcgctcagaccgagcctttatactatcaacaccaaacgtcgaccgactcacccaagtccaacgagagaataatagcagctgcccccgagggcatgcctgacgaaaccatacctgagaatgccccttctaacggcaatgtgtactacgacgtcaatgcacagaatttcttttctgagtttgttcgctggatctcagagaatgggaaccatattcgaaaggcctccaaaatcaccccggtatttgataagttgggcgcatctcacgacccgaaggcgatatcattgatcaatgataggaatcaacacatccaaatgtcaatctcaggatctgggcttatccctggaagcaacaactataccctagaggtatacaataagctcgcgaacagcctcatgtctatgcatagcgctgccgaacgtagcgctacccagctcttgaaatctggcaattgtaaagatgagattaaggagatacagaagcatttgtatgaggtgcgaggaatagctttgaaggagattgagcgaagagacaaagaaaagattggagagtgaaaccaggtagaaaatagttatgcccatagctaagctccggtaaatgaacgtgttagccttggtggccttattgtagaaaccaacctggcgggggttgagactcacatgataatagttgcgtatgtataatagacgatgccagttggagaatgaaggcattggagtcgggggcttatgtatctcaagcttcttgaaaatgcaatgtgactcaattaacgagagagaggacatgcatgcactgtctttgtcctctccaaagcataagcatatagctttaaaagcagcactaacttgaaagctgcctgtatccctcacaagtcggctcatcttcagatcatgatcagcaatgccacataggggccaacgggcacactcacctggtctaaatccattggaggaataataagaatgctattagtcggcatatgggtgacagctgctgtaggcaagccgccgaagaccggaagaaagtgcgaggtgatgaaggccatgtcattgagcttggaaagctttctccgttctttattctttgcgatgcagacccctacgatctcgcgccattgttcgaggcacgcaaggggctgccattgacgctgttcgtaggataacgagtgaaacaacctagtcatggtccattgtaaagtgaaggaggcagccggatcttggatagccacgtcaaaccacccctcaagcacgttgctagcctgagtgacagcctggtccagtcgaatacggtgttttgtccctcgagccttctcatcccgtagaaatgtgactgtaattccaccgccgcctgacaggatccgcggggcctccgtggtgcgattcatgttattcatggtgttgagtgaaagaggaagtaaaatcgatcaacagaccaacagttcagctccttatataggccacccaaaatctcgtgcagtaaaccctccaccacccggttcggacagtggccgcatgagctatgcatgcatgacttgccacctcgcctgggagggtgcagggnggttgtcttacagagtcgatcaggtcgttcaaatatcttttctctttttcagtagcagcctcaagcgtaagaaaaagtggtgctatgaggacgtcggctttatcagagtccacctttttcagatagggaatatccatccacttctggacgcaagcctcccggtactcctgagacaaagtcgattcagatgaattatatatagtgtttatatcgcataatgttcgcaaagcagctaacctgagtgtgattagcccgttgactaaatttgccgcgatatggtcctgtaatcatagctccttcgaatgatcaatcctgggtcaacattaacggataaagtacctagcttaagtgccgtctctaacaacgtagaaagatacatccgtgactcagaagctgcttcttgaacctctcgacgtagactggtcgtgagctttaccatataattgctgtagggattggcgcgaatttggtgtaccacccttgaccacttgggccacagatcatatgacttgccagtagaagccaaagcttgtcttagtaaggatgatattccatctaatttattatcatcgcttatcgcttggtctagttgatacataggcgaagtgttgatcagaaagtgcttgcttcctgcatttgcccaatatcctagctataatatggaagtcagtcaagagaatttgttaaataggagtaaaaaaaagatctaccaaaaagctgcgattttcagctaacagtgcagtacctaatgaatcttttggatccagtaggtcaatcttagttataaggtagctgataccaagcacatggtccacttggtactgttgctggccccagtcaaatagcgtttcagcgcgctcaagtatgcttattgctgctagagtttctacacttagatcgttatatctgagtgtatgttgtaggttgcgaagggctttaatatatgctttcattattccaagctgcatagtgtggcttccccggcgctgattagaccaagccgagcagaagagggcaacacagtcacgtaaacagctactgtgagatagccgttcaagaatatatgggagatacccgatatttaaggtgatgtcctgtttactgcttctctctaggcactcagctagacgggctcctattctatcactgagtgttgtaagacgaggccgggatgtaaccggtatactgcggaaactgaaggagctgtaagagccactttcgtgacagtgtatcttatgtttgcgtagagctagccttttgggaatgttgattgccgacttcgctgtattaggagcctctgtaacacttgatgaagaaggcagtagattgtggtgaacatatttgatatacctagagggacctgggcacttggcattagatctcctacagggacgacaaataggccactcctgattacactgtagcagctttgccaacgattgaaaataataagtagccattaggagcggatagttgattaccttaatcttccgttgcttgcaggttagacaagctttcgaccaaggtaccccggccatcagagagagagagcgcgaaaatgaagatctggtttagcgaaatgatgtatattagcaatgaaaatgtctttacagaaatactggcatttcgatattaagaggatcaaagtgggaaataagttagctaaatatatagtttaagccgcttctgcttggggacaatattttgctccagaaggcgccaatactgatccaggttagagccgaagcgttaatcttactgtgtggattatcatttctcactatacactggtccgcccgaaacccttatgcggagcttgagcttacgctaggtgattctaccctgcttctatatgaataattactgttttatcttgcaattatctgtatagatttataaccctatttgtagtaggtggggcactccaactcgcaccttggcccctatgcaatgaaacaaggttaggaatgctataaagaaatcacagagtataaacatataaggccaaaggtttcattaaaactgcctcaatcttccacctaaagcatgcgattctcaccttcaaacccctaattcaaagatcacatttccgttcaagagcacatatttgcttttgcaaaagcgctccttttaatctctttacctgaaggtgagatttaggcggttgaacctcggcagctttcctgcttagtcactaagctgcacagctctcgcgatacgttccgaaagcgcgctatgcctaatttgtgcgcgctgtagtcaacatgaggtattccacagccaaatagagttgaaccctgccgacaaaagaggaaatagagcaagaatcgattacgtagcaagatatgccacagtttggtttgtcaccacagccgcatatccaagcagtcagcaagatgctaaagacgaaggcattgctcgcacgcgatcgcacctatcaattagcaaactgagattggaaaaagcccgaagcttatgtgagatagctccgttctcattggcttgattttgcgagttggcggcctcactggccgcttcggccgctcccttccaagaaaaagtggctttatataactcgtgacacagtgcgtgctagtagtcggccctcagatacggacttcagggttagcggcgctcctttcagaggaagattcatgctagaggtagctcaatagccaggggaaacctcacacagaagtcctcgaggattcatctagtgacccaccgtgcctatcaccgcgtactgtgccgctattttaacggaaaaattcatccgattcaatgagtctcaaatgataaggaagcacctgataagggcctgggcaagagattctacgccaaatcaagtgggagtcaaactgccatgattagctggtnnnnnnnnnnnnnnnnnnnnnnnnnnnnnnnnnnnnnnnnnnnnnnnnnnctttatataactcgtgacacagtgcgtgctaatagtcggccctcagatacggacttcagggttagcggcgctcctttcagaggaagatccatgctagaggtagctcaatagccaggggaaacctcacacagaagtcctcgaggattcatctaatgacccaccgtgcctatcaccgcgtactgtgccgctattttaacggaaaaattcatccgattcaatgagtctcaaatgatgaaggaagcacctgataagggcctgggcaagagattctacgccaaatcaagtgggagtcaaactgccacgattagctggtcttaccaatcgtcggcatatgctcttgatataattaagatctataccacgtatgctcttagcctaacagtgtttccgtaagtgcatccttacaagtgcaattggattatagccttctgtctaacagcgcttgtgaatttacttttccacataactttatagctaacactttgttaaggagcaatgttaatcactgaaaattgaacgtttatccttttaggctcagaggttaatagatgactttacgaaccctaactacgagatacctgctttacagttgctagttgccaaccaaaccgctgtaaaccaggttggttaatccattatttgttaacaacaaccccactgcttccatgtgttcacaaatagtggcgcgagttattttcaggatatcatgagcattctctctccataattaaccttgtcataaagatcaagctaattgcatacataaatcaacgtgcgaagcgaggatccacgttcaggtccaagccccacctaataattttggctaaccaagatctacgtcaaaatagacaagggttgtctgtcgtaaaatctggaccaattagcttctcagggcttttattagacaagtgttactcattgggctgaacaccaagcttcgacatcacgagccacctcaatgaagaagcacgaaaataaaggaatgtggctcaaacattgagcagagtttggcttcattttgtgattagaatcgactcttttacaatttttcgcgatcggntttggtcataactctttcatatcagattatttcgaacgatattatcataccggcgtgccaacttgtctatgttcgacacatcctctagcaggttgccatgcagctacttttgacttgccaccctccgtcctaacacctgctagattcagatactcgtagagtcaactttccggcaattttccaaggctccactgggctgattgccacccctttttttctcgtttctcgttggaactgggctatagatggacatgcccttgacctcaacttttaggtggcgaaccactattccctgattgtagttagtttatagaaaatatgggcatttcttaattctcataacctacaaccaatcatatttctgtagattccgggtcacaagtggaaaccaagtaatcacagtcttaagtagagggcaaagctattggcatattaaaagctgtacatattggcttcctcgatcgaacgattatagttatgacggctgcctaccgccaacatagtattgagtgttgccgcattgctaaccagttcaatatatgtctggttagcagagggatgtggtattggcaatctatttgctagcatcatagcctagcattctatgcatctcgccagcagtcccctagaatatgtagctttgatcctttgttcttacgagcaagcgccgtacacgtagggtctcggagtggtggtctgggagggtcggctcgtacgaggattccccaatgtagcaattgcggcaagcctggtcataatattcaaactcgtaaggagatatctaatgaatcaggttttagtgttattattatagataattaggttacgttattttaattgaggtttatgtatatttaagggataggtggaagtggtccactcgcttgtttgctccactcgcttgtggattacgttaatgagtattttgaagatgggtgaaagatgaaggagttgttttgtttgttttcaaatttcaaactgaccgaagaaaggaggatctatatacctatttcctccccctctgcctccctgccttgccttatcttcactctcatctttctatacagaggctcaggattgaatactcaaagtgtgccagagataaaaattggaagcgctagagtccatatctccgggtctgacatcccaacataaagaatccttcgcgtttgacaagttgaattcctcggctgtgattggtttactatccgagcccaacaggggtgtcagggaaaataagatagtatttgtgccgtagctaacgggataactaactgctggcctgttattatgatttgccgtatcggcaattttgtgtgtcagttgtggtcggttccacaggcctaaatacctaccccccgactttaccatctaattgaactgaagggtgtagccaggggcggcgcgctaccggaatggagctgggcagattgcgttttcacgctgtcttattcctcgcaaaaactggccaatgaacaatggtccgacgggaggcagggaagttctataagccaaggctaccttgtctcgctaagtctaaacatgagaggcggtagaaaccccttctagtaactgcgtactccggagcggatgtaaaaccttgcctaggcgagcacgagcggccacaattttgggacttgattggctcaaactttacgagcacaggaggcccgcatatcgagcttggatctgctccggcttaaatgcttgatttaatgaagcaaaagtaaaagcaagctcggctcctttcatcgttttggtatttgggccgctaactgtctccattatttcatttgaagcgaatcagctcatggtaaacaatgctagcttatgtgagaaaacatgaaaaaagaagcttcaaattcagagggccggtgatatcatgcgctcagcgtgtcctccactgcgcaacaccatggtcagcacgcattgaccagttgggcgagtgcgagaccacactgcacagtcagctttcatgcgggctgaccgggatgctatgctgagagcgtcgtatctggtgtgcagtcaataatgttagcctcaatgtgtgaccaccggccggccctctgtgtgactacccgcgggagtcccgtaggtacatgtcatcactacatgccagtgcccttcactttttcctcttctcgggttttcttttcttggtttccttcatgaatcgttcgttgaatcttgagcccttcgcaagtatatgtgcgcatcagaactctcgcgtgtatgattgacttggcgacttgggcgtacatacccactcatcgatacaccatgttccattcgatcatcgtccagctgctgatggcagccagttctctacccgtctctgtctcggccgacgaagtaaannnnnnnnnnnnnnnnnnnnnnnnnnnnnnnnnnnnnnnnnnnnnnnnnnatggtaaacaatgctagcttatgtgagaaaacatgaaaaaagaagcttcaaattcagagggccggtgatatcatgcgcttagcgtgtcctccactgcgcaacacgatggtcagcacgcattgaccagttgggcgagcgcgagaccacattacacagtcagctttcatgcgggctgaccgggatgccatgctgagagcgtcgtatctggtgtgcactcaataatgttagcctcaatgtgtgaccaccggccggccctctgtgtgactacccgcgggagtcccgtaggtacatgtcatcactacatgccagtgcccttcactttttcctcttctcggattttcttttcttggtttccttcttgaatcgttcgttgaatcttgagtccttcgcaagtatatgtgcgcatcagaactctcgcgtgtatgattgacttggcgacttgggcgtacatacccactcatctagagcggccgcgatggcgaacaaggccttgtagctcattggtttgacgacggaggcgaacgtctcgtcgtagtcgatgtcctcttcttgtgtgaagcccctaaccacccatctgctcttgtgacgggtgacctctccatgcgatccttgtttgagcttgaagacccatctgccactgaggacccgtcgatctctgggagggttaacaagctcccacgtcttgttttgtttaagtgaagcgacttcttcaagcatcgccctttcccattcgggccagcttgtatcattctttgcttcgtgaacagttttcggttcaaagggttccgtttcttccgcagctactgtcaagaacgtcgggatcacgttgccttccgatacattcatcagcgcgagctcttctatgctctcatcggatgtatcggatgcggcccgcggaatacggattctgagttcagggtgatattctaaggcttgttgcctcactccatgaactggacgatcaagatggagcctcggatctctttcccgttctcctgagtcttgatcgtgtcgagtgccgtcccgttgctggtcaccattgggcagtgaatcgtctctttctgggacatctgtaaaagacccgaaagtatcgtcactcccagacggcgacaaggtcctgtctccctgttcagcaactggctgcgagtcatcgtcactcgattgggactgctctcgctctcccgagtcatcgtcactcggtcgagatagtattcgcgagtcatcgtcacccgcccgaggtagtatttgcgagtccccgtcgcccgcccaaggtagtacttgcgggtccttggtgcccgcccgaggtagtatttccgagtcctcagtgctcgtacgaggtaattcttgcaagtcctcgcggcttgtttcggacaagacattctctgcttctaccacggacgcgtgacgtccagaagctgccacggatgtctgccgtatacttaccgacggttggtttaatagccccaccgtctgactcccccctgcggcagcagccgttgcctcaggtgaaccatatcgtttggctcccacatcttgtttagtctgtgtggagggagtcataagggcttcttggaattcggcgtttggggtcccaacaattcttccgtcttccagtaggatgcggtagttggtgtttccctcgtagcctaatagaatgcatggccttgttcgcggctctgtaagcttctttctttgcttcaatgggaccaggtattccccttttgacccgatcacccttagccgtgataagtcaggcttctcgccgtaccatgcctggtacggtgtcatctgaagcttcgacgagggcgatctattggaaaggtatgctgctgttcgagctatctcgggacaaaattttgatgggagtttagcatgggctagcgtaggcccgactcgatcatatattgtcctgtgggctctttcggcaacgccgttttgttggtgttgatcaacaccagtgacctcggcttggattgcccgagagaaaagtaaaaatttcatttgttctcccacttgctcagggattcggtcaagtcgtattcgcctgcatttccgttcagggcgctcgttatgatcgagaaagaaacgcagtgactcaatgacaaatccctgtcgtcttggtatggggatgacttcgatccacccggttgagtcatcgacaatggtgagccagtagcgactaccatcaagaccctcttcaaacggtcctgcgacgtccatgtgaagaaactccattggatattcaccttttctgcctgggcggttatgcggcttctcggtcattcgcccctggaggcagggattgcatggttctcgtggttgcacgtctcgaatgccgtgggcttgcttcttcagccgccgcaaattcgcatcgctcagatgggccagtcggttgtgccagagggtcatttgtggactgacgtggtaggctggaaaagagaggttcgtccataggtcgagtgcgtaaacaccgtggtatttgcttgcggtgtaccagctcttatttaatttgttgcagatacttgcgccattgcttgagaactcgatcttggcccctcgttcgagcaactggagcactgatatgaggtttgcttgtgcagatgcgacaaagaggacattgtcaagaacaagccatctccttctgccccgtacattgcacaggatattcaccgtccctatccctgaaggggacgtagacgtgtcaacgctcctgagtgcgggaccgtgatactcgttcatctgaacaaacttcgaggcgtcattgcatacgtgttgggcagaaccactgtcgacgatccaggcgtcgcggatagggagcgtcctcgtagccatcattgcaaaagtatgtgcagcgcaattgtgttcgatgtcctttccgaatgccgcattaacatcctctcctgtagccttgatcgccatgaaggtgggcttcttcgggttattcggaccaaccgcatcatcattctcgtcatcagtggagtgctgtctctttaatggtttgcgaccgttggcttgtgagccccgtgcccttgctttgtgtgctctttcgtctttcccttttagcttcggatttctcttgaagcactcggtttcgacgtgatagggtttttggcagcaggagcagtagggaacgttatcgatctctattcggcatgtagctccgtctgatgacggaatgagcttcttttgcccggggcctcgaaccaaggcaagaacagggagcgcttgcccctcacttggtcgttttcccagctgtccttttctatgctcttcctcaattgccttgttttcaatgtagtcgaatgtgggtgctgctttgactacgtttccgtctgcgtctctgtcgtttacaaggtccatttgtctgaatatatggtcacggaaagcttcatactccgcgcccagtgcgtgcatgaagaagaacgtccgttcaatttccgacgtcacgcagtcgggatcaaggaggagtttttcagagtgaattcttctgatctcggctccaagggcttgggcgcttccacacttttctcgcgtgagggacatgtatcgtcgttggagatttacgtaggttccggagccttccggtttgaagttctccttgactgccctgaggagggaatagacttgatgtatttcgaaggcattgattcgttgtgcagcattgtgtgtcagctttgccgttagcattgccgagtagaacttctggcggcggtcccattgtcgagcctcttcttcttccaaaggtggggctgctttatcttcagcaacagccgatatttgaatgaattcgttgaccttctgattccacttgaaccagtcattggcattgtccagtgttgggatagcattgtagaacgcgccgaggccgaattgttcaaacttcgcaatgtctgtcatggtgagggtagatattcctctgcactgaggaactcttcgccaggtgaatttggagcgatggaaacacttgagtctgaacagttgattgattgtacttctaggccaaagagatctaagcttgaagcgtcactgacgagactcaacgcgacagagggactgcgatcactcgatcccggtgtgggtggttgagaaggtggagagtaatctgtgtcaggtgttgcgtgttgtctccagtaagtttcgtacgcctgggagaaatggggaaatcgtatgcggtcaactagacacggcgaactatcgttcgtgaagttcttaggtctgtttagtcgaaaattatagcgaccgatggttctattttttgccgaggttacccattcgtccccagaacttgatgcagtcaaggccgcgagctcgatcctatttcctgtctgaacagaactcgagttgacgggaatgggtcgacttgttccttgtttagaggaaggaatggttatgggagttctattgtggatgtcgcttatttcgctaacaatgttcgtaggggcgacagaatgaatcagtgctgctgacacacgctgcatgcgttcctcagtcggtatgtgtgtgtaggctagcctaactgcagctgccgtttttgatggaaagaatgttctctgaatttgaacccagctccaattgcggcgtaatcgaagatacgtggtgagatttagttcttcatccgtccagcggtgaagtgtttgtcgctgccttctttgtggtcgcggtggcttctttggagatattgtcgccagttgaagaatgtcgaccaacgatccggcgactggatttggcattttaaagtccattatgtattgcatgcccttctgctgaagtagcttttgggcttgcacattcggtctttgatatgtccttttcttgcggtttcacgactgtggcaccaacnggctgccttttcattggttcaattttacgaggtgagatgtttgctcatgggtctacgctaacggatattgcaccggggggagatacgagacaaagtgacacgagctaaaaccggcatgattggcttcttccgagatatccacacaagcgcattagcacgggggttcgatcgtccatgccagtggtctatcactgtcgggattgcatacggcagactgcagtatcgtatcacatactgatcaacagactttttcggccaacctctggcagcggcaatcccacgtgtttgcagtactgtacttgcttccctatactagcaaccgaattctgcacagatagctttagcagaacaacgggaatccgagcgggatgccaagggagaagagaccaaatgccaaacggtacagcttgaaagtcagagttcattctttcagctgggtgagcaactgaagggatgcatttatagtgaaccaacagggtgagtgggttaagagagttcactaggcaagcagagggcaagaagggccaattgaaatccgcgcaaaaagcataccgagaccgacttgataccgctatggaagagcagagtagggtttttatcctgtacatagaaaggttttcccctgctagagattaagcagaggggaaagggcctaggatagatagcatctagaggaataaacaataataatataaatattattgagttgggatttcttaattatagtttgaaatcaaattaaatttactgacttattaattgattattttgctttgtatttgttttgttgttacgaattcacatacgccacacgatcacgtggcatactctactatttttcaccaatcaaggacggatcattaaggataaccactgagcctcagtgatccccacgtatatatacccactcatttcattagttagaacactcctttagatagttatcagtaacagttgctaccgcgtcattaaaactagttccttagtgctcgcacattagctgtgactcgcagtgcgagaccgacaccctgatcgttcttctcagaaaaatcaacaatcgtcacttaccctaggcccatatctctactactttatgtttgctaagaacgcgaaggccgccttggttgcctggcggtgccggttagcctcaacagtgatactggcattgagagcgatagttggaatttggttagatctgatttgtgtgaaactcatactgaaggatccaaagcctgatctattccattttgggaagtatagtaataactactaagcagtattacatttatctgtacggacggagcctcgtaactgtgacaatccaccacagctttaatataacatatagtagtcggactcctattttctaataaacgaataagcctagtctatatagttactattaacacgttaagcgcataacatcaccagcgtccaggcactcctttaatgatgttagtcattttgtcttttctcttctgataacttcataagctaaggagactaggtaattttcgaatcgatctcggcacgatgggaacgcttctgaacgaatcaggcgagctcctcctatcttatggtactaacttggatgatgcgggggttttagtgaccgaaacatggcaatgatagacaagtagctattattactattattacgcacgactctggttggagggcatgttagtaatactaacgacttttacatgtgaattattacggagaattgactcaggatttattcatttttcgtannnnnnnnnnnnnnnnnnnnnnnnnnnnnnnnnnnnnnnnnnnnnnnnnnctaaggagactaggtaattttcgaatcgatctcggcacgatgggaacgcttctgaacgaatcaggcgagctcctcctatttcatggtactaacttggatgatgccggggatttagtgaccgaaacatggcaatgatagacaagtagctattattactattattacgcacgactctggttgaagggcatgttagtaatactaacgacttttacatgtgaattattacggagaattgactcaggatttattcatttttcgtagtatctctactaggtatttagtcgtgagttatatgttttaagacgatagtttacaaaaaatgaatgagattcctgtaagcgtatactatgcttaactcgccgttctgattattagattatcgggtcaaagcaaaaccctttacagctgaccaacgactttgggaagcggaatcccttaaacctcccctcgcttgtgctatacttcccaaccttacatacacatgccactctaaaatctttgaaatatcttgctttcaatgggtctcaaacccgtagaggttttgtggcaacacaaaaggctgtccgagactgcttgctcttcattggccggttttacgaggtcagtcatactacgtggccctgctcgtgccccacctatccctggtcttaactaagccctagggcattattaatatgaagagaatgcatgaagcaggtccgatgggcgcgaggtccgacagatccacctatactaatgacctaaatctgtgccgagatctcaagtttagcgtctcttctctgtctagcttggctg
